(12) United States Patent
Raum et al.

(10) Patent No.: US 10,294,300 B2
(45) Date of Patent: May 21, 2019

(54) ANTIBODY CONSTRUCTS FOR DLL3 AND CD3

(71) Applicant: AMGEN RESEARCH (MUNICH) GMBH, Munich (DE)

(72) Inventors: Tobias Raum, Munich (DE); Claudia Blümel, Munich (DE); Christoph Dahlhoff, Munich (DE); Patrick Hoffmann, Munich (DE); Peter Kufer, Munich (DE); Ralf Lutterbüse, Munich (DE); Elisabeth Nahrwold, Munich (DE); Jochen Pendzialek, Munich (DE)

(73) Assignee: AMGEN RESEARCH (MUNICH) GMBH, Munich (DE)

( * ) Notice: Subject to any disclaimer, the term of this patent is extended or adjusted under 35 U.S.C. 154(b) by 11 days.

(21) Appl. No.: 15/225,107

(22) Filed: Aug. 1, 2016

(65) Prior Publication Data

US 2017/0037130 A1  Feb. 9, 2017

Related U.S. Application Data

(60) Provisional application No. 62/290,896, filed on Feb. 3, 2016, provisional application No. 62/199,930, filed on Jul. 31, 2015.

(51) Int. Cl.
| | | |
|---|---|---|
| *A61K 39/395* | (2006.01) | |
| *C07K 16/18* | (2006.01) | |
| *C07K 16/22* | (2006.01) | |
| *C07K 16/28* | (2006.01) | |
| *C07K 16/30* | (2006.01) | |
| *A61K 39/00* | (2006.01) | |
| *C07K 14/475* | (2006.01) | |
| *C07K 14/725* | (2006.01) | |

(52) U.S. Cl.
CPC .... *C07K 16/2809* (2013.01); *A61K 39/00113* (2018.08); *A61K 39/3955* (2013.01); *A61K 39/39558* (2013.01); *C07K 16/18* (2013.01); *C07K 16/28* (2013.01); *A61K 2039/505* (2013.01); *C07K 16/22* (2013.01); *C07K 16/30* (2013.01); *C07K 2317/31* (2013.01); *C07K 2317/33* (2013.01); *C07K 2317/34* (2013.01); *C07K 2317/51* (2013.01); *C07K 2317/515* (2013.01); *C07K 2317/56* (2013.01); *C07K 2317/622* (2013.01); *C07K 2317/73* (2013.01); *C07K 2317/76* (2013.01); *C07K 2317/77* (2013.01); *C07K 2317/92* (2013.01); *C07K 2317/94* (2013.01)

(58) Field of Classification Search
CPC ............ C07K 2317/73; C07K 2317/92; C07K 2317/76; C07K 2317/31; C07K 16/18; C07K 16/24; C07K 16/2809; C07K 2317/565; C07K 2317/33; C07K 2317/56; C07K 2317/51; C07K 2317/515; C07K 16/22; C07K 16/468; A61K 2039/505; A61K 39/03

See application file for complete search history.

(56) References Cited

U.S. PATENT DOCUMENTS

| | | | |
|---|---|---|---|
| 3,691,016 | A | 9/1972 | Patel et al. |
| 3,773,919 | A | 11/1973 | Boswell et al. |
| 3,969,287 | A | 7/1976 | Jaworek et al. |
| 4,179,337 | A | 12/1979 | Davis et al. |
| 4,195,128 | A | 3/1980 | Hildebrand et al. |
| 4,229,537 | A | 10/1980 | Hodgins et al. |
| 4,247,642 | A | 1/1981 | Hirohara et al. |
| 4,301,144 | A | 11/1981 | Iwashita et al. |
| 4,330,440 | A | 5/1982 | Ayers et al. |
| 4,439,196 | A | 3/1984 | Higuchi |
| 4,447,224 | A | 5/1984 | DeCant, Jr. et al. |
| 4,447,233 | A | 5/1984 | Mayfield |
| 4,475,196 | A | 10/1984 | La Zor |
| 4,485,045 | A | 11/1984 | Regen |
| 4,486,194 | A | 12/1984 | Ferrara |
| 4,487,603 | A | 12/1984 | Harris |
| 4,496,689 | A | 1/1985 | Mitra |
| 4,544,545 | A | 10/1985 | Ryan et al. |

(Continued)

FOREIGN PATENT DOCUMENTS

| | | |
|---|---|---|
| EP | 0036676 A1 | 9/1981 |
| EP | 0058481 A1 | 8/1982 |

(Continued)

OTHER PUBLICATIONS

Kumar et al. Molecular cloning and expression of the Fabs of human autoantibodies in *Escherichia coli*. J Biol Chem 275(45): 35129-35136, 2000.*

(Continued)

*Primary Examiner* — Bridget E Bunner
(74) *Attorney, Agent, or Firm* — Marshall, Gerstein & Borun LLP

(57) ABSTRACT

The present invention relates to a bispecific antibody construct comprising a first binding domain which binds to human DLL3 on the surface of a target cell and a second binding domain which binds to human CD3 on the surface of a T cell. Moreover, the invention provides a polynucleotide encoding the antibody construct, a vector comprising said polynucleotide and a host cell transformed or transfected with said polynucleotide or vector. Furthermore, the invention provides a process for the production of the antibody construct of the invention, a medical use of said antibody construct and a kit comprising said antibody construct.

16 Claims, 12 Drawing Sheets

Figure 1:
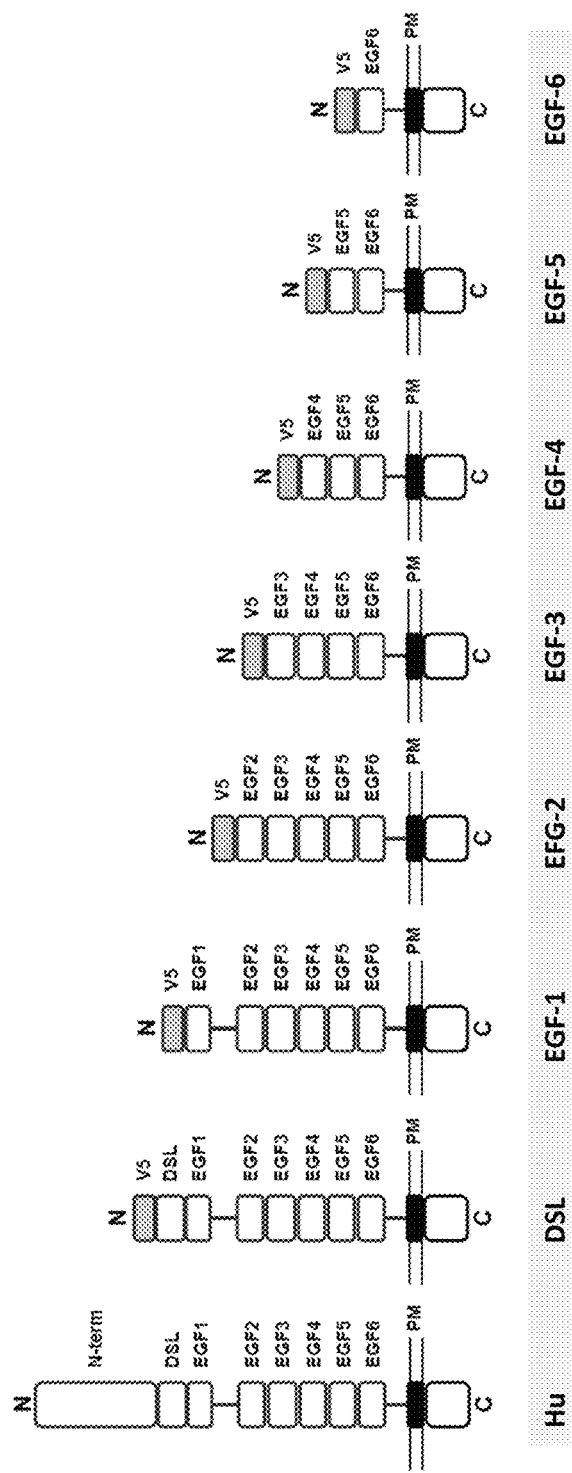

Specification includes a Sequence Listing.

(56) References Cited

U.S. PATENT DOCUMENTS

| | | |
|---|---|---|
| 4,596,556 A | 6/1986 | Morrow et al. |
| 4,640,835 A | 2/1987 | Shimizu et al. |
| 4,670,417 A | 6/1987 | Iwasaki et al. |
| 4,751,180 A | 6/1988 | Cousens et al. |
| 4,790,824 A | 12/1988 | Morrow et al. |
| 4,791,192 A | 12/1988 | Nakagawa et al. |
| 4,816,397 A | 3/1989 | Boss et al. |
| 4,816,567 A | 3/1989 | Cabilly et al. |
| 4,935,233 A | 6/1990 | Bell et al. |
| 4,941,880 A | 7/1990 | Burns |
| 4,946,778 A | 8/1990 | Ladner et al. |
| 5,013,556 A | 5/1991 | Woodle et al. |
| 5,064,413 A | 11/1991 | McKinnon et al. |
| 5,223,409 A | 6/1993 | Ladner et al. |
| 5,225,539 A | 7/1993 | Winter |
| 5,292,658 A | 3/1994 | Cormier et al. |
| 5,312,335 A | 5/1994 | McKinnon et al. |
| 5,383,851 A | 1/1995 | McKinnon, Jr. et al. |
| 5,399,163 A | 3/1995 | Peterson et al. |
| 5,418,155 A | 5/1995 | Cormier et al. |
| 5,476,996 A | 12/1995 | Wilson et al. |
| 5,545,806 A | 8/1996 | Lonberg et al. |
| 5,545,807 A | 8/1996 | Surani et al. |
| 5,565,332 A | 10/1996 | Hoogenboom et al. |
| 5,569,825 A | 10/1996 | Lonberg et al. |
| 5,585,089 A | 12/1996 | Queen et al. |
| 5,591,669 A | 1/1997 | Krimpenfort et al. |
| 5,612,205 A | 3/1997 | Kay et al. |
| 5,625,126 A | 4/1997 | Lonberg et al. |
| 5,625,825 A | 4/1997 | Rostoker et al. |
| 5,633,425 A | 5/1997 | Lonberg et al. |
| 5,643,763 A | 7/1997 | Dunn et al. |
| 5,648,260 A | 7/1997 | Winter et al. |
| 5,661,016 A | 8/1997 | Lonberg et al. |
| 5,683,888 A | 11/1997 | Campbell |
| 5,693,761 A | 12/1997 | Queen et al. |
| 5,693,762 A | 12/1997 | Queen et al. |
| 5,698,767 A | 12/1997 | Wilson et al. |
| 5,721,367 A | 2/1998 | Kay et al. |
| 5,741,668 A | 4/1998 | Ward et al. |
| 5,770,429 A | 6/1998 | Lonberg et al. |
| 5,777,079 A | 7/1998 | Tsien et al. |
| 5,789,215 A | 8/1998 | Berns et al. |
| 5,789,650 A | 8/1998 | Lonberg et al. |
| 5,804,387 A | 9/1998 | Cormack et al. |
| 5,814,318 A | 9/1998 | Lonberg et al. |
| 5,859,205 A | 1/1999 | Adair et al. |
| 5,874,299 A | 2/1999 | Lonberg et al. |
| 5,874,304 A | 2/1999 | Zolotukhin et al. |
| 5,876,995 A | 3/1999 | Bryan |
| 5,877,397 A | 3/1999 | Lonberg et al. |
| 5,925,558 A | 7/1999 | Tsien et al. |
| 5,939,598 A | 8/1999 | Kucherlapati et al. |
| 5,958,765 A | 9/1999 | Brams et al. |
| 5,981,175 A | 11/1999 | Loring et al. |
| 6,023,010 A | 2/2000 | Krimpenfort et al. |
| 6,075,181 A | 6/2000 | Kucherlapati et al. |
| 6,114,598 A | 9/2000 | Kucherlapati et al. |
| 6,150,584 A | 11/2000 | Kucherlapati et al. |
| 6,162,963 A | 12/2000 | Kucherlapati et al. |
| 6,255,458 B1 | 7/2001 | Lonberg et al. |
| 6,300,064 B1 | 10/2001 | Knappik et al. |
| 6,407,213 B1 | 6/2002 | Carter et al. |
| 6,673,986 B1 | 1/2004 | Kucherlapati et al. |
| 9,089,615 B2 * | 7/2015 | Stull .................. A61K 47/6891 |
| 2003/0070185 A1 | 4/2003 | Jakobovits et al. |
| 2012/0328624 A1 * | 12/2012 | Yoshida ............. C07K 16/3023 424/139.1 |
| 2014/0302037 A1 | 10/2014 | Borges et al. |
| 2014/0308285 A1 | 10/2014 | Yan et al. |
| 2014/0364590 A1 * | 12/2014 | Stull .................. A61K 47/6855 530/387.3 |
| 2017/0218078 A1 * | 8/2017 | Raum ................ C07K 16/2878 |
| 2017/0349668 A1 * | 12/2017 | Rattel .................. C07K 16/468 |

FOREIGN PATENT DOCUMENTS

| | | |
|---|---|---|
| EP | 0088046 A2 | 9/1983 |
| EP | 0133988 A2 | 3/1985 |
| EP | 0143949 A1 | 6/1985 |
| EP | 0171496 A2 | 2/1986 |
| EP | 0173494 A2 | 3/1986 |
| EP | 0239400 A2 | 9/1987 |
| EP | 0463151 A1 | 1/1992 |
| EP | 0773288 A2 | 5/1997 |
| EP | 0546073 B1 | 9/1997 |
| EP | 0843961 A1 | 5/1998 |
| GB | 2177096 A | 1/1987 |
| JP | 3 068 180 B2 | 7/2000 |
| JP | 3 068 507 B2 | 7/2000 |
| WO | WO-1987/005330 A1 | 9/1987 |
| WO | WO-1988/009344 A1 | 12/1988 |
| WO | WO-1992/003918 A1 | 3/1992 |
| WO | WO-1992/015673 A1 | 9/1992 |
| WO | WO-1992/022645 A1 | 12/1992 |
| WO | WO-1992/022647 A1 | 12/1992 |
| WO | WO-1992/022670 A1 | 12/1992 |
| WO | WO-1993/012227 A1 | 6/1993 |
| WO | WO-1993/015722 A1 | 8/1993 |
| WO | WO-1994/000569 A1 | 1/1994 |
| WO | WO-1994/002602 A1 | 2/1994 |
| WO | WO-1994/010308 A1 | 5/1994 |
| WO | WO-1994/025585 A1 | 11/1994 |
| WO | WO-1995/007463 A1 | 3/1995 |
| WO | WO-1996/014436 A1 | 5/1996 |
| WO | WO-1996/033735 A1 | 10/1996 |
| WO | WO-1996/034096 A1 | 10/1996 |
| WO | WO-1997/013852 A1 | 4/1997 |
| WO | WO-1997/038731 A1 | 10/1997 |
| WO | WO-1998/014605 A1 | 4/1998 |
| WO | WO-1998/024884 A1 | 6/1998 |
| WO | WO-1998/024893 A2 | 6/1998 |
| WO | WO-1998/026277 A2 | 6/1998 |
| WO | WO-1998/052976 A1 | 11/1998 |
| WO | WO-1999/049019 A2 | 9/1999 |
| WO | WO-1999/054440 A1 | 10/1999 |
| WO | WO-2000/006605 A2 | 2/2000 |
| WO | WO-2000/034317 A2 | 6/2000 |
| WO | WO-2000/076310 A1 | 12/2000 |
| WO | WO-2003/047336 A2 | 6/2003 |
| WO | WO-2004003019 A2 * | 1/2004 |
| WO | WO-2005/040220 A1 | 5/2005 |
| WO | WO-2006/138181 A2 | 12/2006 |
| WO | WO-2007/042261 A2 | 4/2007 |
| WO | WO-2007/098420 A2 | 8/2007 |
| WO | WO-2008/119567 A2 | 10/2008 |
| WO | WO-2009/127691 A1 | 10/2009 |
| WO | WO-2010/037838 A2 | 4/2010 |
| WO | WO-2011/051489 A2 | 5/2011 |
| WO | WO-2012/059486 A1 | 5/2012 |
| WO | WO-2012/150319 A1 | 11/2012 |
| WO | WO-2013/026833 A1 | 2/2013 |
| WO | WO-2013/026837 A1 | 2/2013 |
| WO | WO-2013/075066 A2 | 5/2013 |
| WO | WO-2013/126746 A2 | 8/2013 |
| WO | WO-2013/135896 A1 | 9/2013 |
| WO | WO-2014/072481 A1 | 5/2014 |
| WO | WO-2014/144722 A2 | 9/2014 |
| WO | WO-2014/151910 A1 | 9/2014 |
| WO | WO-2015/048272 A1 | 4/2015 |

OTHER PUBLICATIONS

Smith-Gill et al Contributions of immunoglobulin heavy and light chains to antibody specifcity for lysozyme and two haptens. J Immunol 139: 4135-4144, 1987.*

Song et al. Light chain of natural antibody plays a dominant role in protein antigen binding. Biochem Biophys Res Comm 268: 390-394, 2000.*

U.S. Appl. No. 07/466,008, Kucherlapati et al.

U.S. Appl. No. 07/574,748, Kay et al.

U.S. Appl. No. 07/575,962, Lonberg et al.

U.S. Appl. No. 07/610,515, Kucherlapati et al.

(56) References Cited

OTHER PUBLICATIONS

U.S. Appl. No. 07/904,068, Lonberg et al.
U.S. Appl. No. 07/919,297, Kucherlapati et al.
U.S. Appl. No. 08/112,848, Kucherlapati et al.
U.S. Appl. No. 08/155,301, Lonberg et al.
U.S. Appl. No. 08/161,739, Lonberg et al.
U.S. Appl. No. 08/165,699, Lonberg et al.
U.S. Appl. No. 08/209,741, Kay et al.
U.S. Appl. No. 08/234,145, Kucherlapati et al.
U.S. Appl. No. 08/376,279, Kucherlapati et al.
U.S. Appl. No. 08/430,938, Kucherlapati et al.
U.S. Appl. No. 08/462,837, Kuchlerapati et al.
U.S. Appl. No. 08/463,191, Kuchlerapati et al.
U.S. Appl. No. 08/464,584, Kuklerapati et al.
U.S. Appl. No. 08/486,853
U.S. Appl. No. 08/486,859.
U.S. Appl. No. 08/759,620, Jakobovits et al.
Altschul et al., Basic local alignment tool. *J. Mol. Biol.* 215: 403-10 (1990).
Altschul et al., Gapped BLAST and PSI-BLAST: a new generation of protein database search programs. *Nucl. Acids Res.* 25: 3389-402 (1993).
Altschul et al., Local alignment statistics. *Meth. Enzymol.* 266: 460-80 (1996).
Aplin et al., Preparation, properties, and applications of carbohydrate conjugates of proteins and lipids. *CRC Crit. Rev. Biochem.* 259-306 (1981).
Arakawa et al., Solvent interactions in pharmaceutical formulations. *Pharm Res.* 8(3): 285-91 (1991).
Artsaenko et al., The expression of a single-chain Fv antibody against abscisic acid creates a wilty phenotype in transgenic tobacco. *The Plant J.* 8: 745-50 (1995).
Brühl et al., Depletion of CCR5-expressing cells with bispecific antibodies and chemokine toxins: a new strategy in the treatment of chronic inflammatory diseases and HIV. *Immunol.* 166: 2420-6 (2001).
Carter et al., High level *Escherichia coli* expression and production of a bivalent humanized antibody fragment. *Biotechnology* 10: 163-7 (1992).
Chalfie et al., Green fluorescent protein as a marker for gene expression. *Science* 263: 802-5 (1994).
Cheadle et al., Cloning and expression of the variable regions of mouse myeloma protein MOPC315 in *E. coli*: recovery of active FV fragments. *Mol. Immunol.* 29: 21-30 (1992).
Cheson et al., Report of an international workshop to standardize response criteria for non-Hodgkin's lymphomas. NCI Sponsored International Working Group. *J. Clin. Oncol.* 17(4): 1244 (1999).
Chothia et al., Canonical structures for the hypervariable regions of immunoglobulins. *J. Mol. Biol.* 196: 901-17 (1987).
Chothia et al., Conformation of immunoglobulin hypervariable regions. *Nature* 342: 877-83 (1989).
Clackson et al., Making antibody fragments using phage display libraries. *Lett. Nature* 352: 624-8 (1991).
Cook et al., The human immunoglobulin VH repertoire. *Immunol. Today,* 16(5): 237-42 (1995).
Cunningham et al., High-resolution epitope mapping of hGH-receptor interactions by alanine-scanning mutagenesis. *Science* 244: 1081-5 (1989).
Dall'Acqua et al., Contribution of domain interface residues to the stability of antibody CH3 domain homodimers. *Biochemistry* 37: 9266-73 (1998).
Devereux et al., A comprehensive set of sequence analysis programs for the VAX. *Nucl. Acid. Res.* 12: 387-95 (1984).
Duskin et al., Relationship of the structure and biological activity of the natural homologues of tunicamycin. *J. Biol. Chem.* 257(6): 3105-9 (1982).
Edge et al., Deglycosylation of glycoproteins by trifluoromethanesulfonic acid. *Anal. Biochem.* 118: 131-7 (1981).

Eppstein et al., Biological activity of liposome-encapsulated murine interferon γ is mediated by a cell membrane receptor. *Proc. Natl. Acad. Sci. USA* 82: 3688-92 (1985).
Fecker et al., Expression of single-chain antibody fragments (scFv) specific for beet necrotic yellow vein virus coat protein or 25 kDa protein in *Escherichia coli* and *Nicotiana benthamiana*. *Plant Mol. Biol.* 32: 979-86 (1996).
Feng et al., Progressive sequence alignment as a prerequisite to correct phylogenetic trees. *J. Mol. Evol..* 35: 351-60 (1987).
Gabizon et al., Pharmacokinetics and tissue distribution of doxorubicin encapsulated in stable liposomes with long circulation times. *J. Natl. Cancer Inst.* 8: 1484-8 (1989).
Graham et al., Characteristics of a human cell line transformed by DNA from human adenovirus type 5. *J. Gen Virol.* 36: 59-74 (1977).
Green et al., Antigen-specific human monoclonal antibodies from mice engineered with human Ig heavy and light chain YACs. *Nat. Genet.* 7: 13-21 (1994).
Green et al., Regulation of B cell development by variable gene complexity in mice reconstituted with human immunoglobulin yeast artificial chromosomes. *J. Exp. Med.* 188: 483-95 (1998).
Hakimuddin et al., A chemical method for the deglycosylation of proteins. *Arch. Biochem. Biophys.* 259: 52-7 (1987).
Hawkins et al., Selection of phage antibodies by binding affinity. *J. Mol. Biol.* 254: 889-96 (1992).
Heim et al., Engineering green fluorescent protein for improved brightness, longer wavelengths and fluorescence resonance energy transfer. *Curr. Biol.* 6: 178-82 (1996).
Hiatt et al., Production of antibodies in transgenic plants. *Nature,* 342: 76-8 (1989).
Higgins et al., Fast and sensitive multiple sequence alignments on a microcomputer. *CABIOS* 5: 151-3 (1989).
Holliger et al., "Diabodies": small bivalent and bispecific antibody fragments. *Proc. Natl. Acad. Sci. USA,* 90(14): 6444-8 (1993).
Hoppe et al., A parallel three stranded alpha-helical bundle at the nucleation site of collagen triple-helix formation. *FEBS Lett.* 344: 191-5 (1994).
Huston et al., Protein engineering of antibody binding sites: recovery of specific activity in an anti-digoxin single-chain Fv analogue produced in *Escherichia coli*. *Proc. Natl. Acad. Sci. USA* 85: 5879-83 (1988).
Hwang et al., Hepatic uptake and degradation of unilamellar sphingomyelin/cholesterol liposomes: A kinetic study. *Proc. Natl. Acad. Sci. USA* 77: 4030-4 (1980).
Ichiki et al., Regulation of the expression of human C epsilon germline transcript. Identification of a novel IL-4 responsive element. *J. Immunol.* 150: 5408-17 (1993).
Jones et al., Replacing the complementarity-determine regions in a human antibody with those from a mouse. *Nature* 321: 522-5 (1986).
Karlin et al., Applications and statistics for multiple high-scoring segments in molecular sequences. *Proc. Natl. Acad. Sci. USA* 90: 5873-7 (1993).
Kaufman, Selection and coamplification of heterologous genes in mammalian cells. *Meth. Enzymol.* 185: 537-66 (1990).
Kipriyanov et al., Bispecific tandem diabody for tumor therapy with improved antigen binding and pharmacokinetics. *J. Mol. Biol.* 293: 41-56 (1999).
Kohler et al., Continuous cultures of fused cells secreting antibody of predefined specificity. *Nature* 256:495-7 (1975).
Kozbor et al., The production of monoclonal antibodies from human lymphocytes. *Immunol. Today* 4(3): 72-9 (1983).
Kufer et al., A revival of bispecific antibodies. *Trends Biotechnol.* 22(5): 238-44 (2004).
Kufer et al., Construction and biological activity of a recombinant bispecific single-chain antibody designed for therapy of minimal residual colorectal cancer. *Cancer Immunol. Immunother.* 45: 193-7 (1997).
Langer et al., Biocompatibility of polymeric delivery systems for macromolecules. *J. Biomed. Mater. Res.* 15(2): 267-77 (1981).
Langer, Controlled release of macromolecules, *Chem. Tech.* 12: 98-105 (1982).
Lowman et al., Selecting high-affinity binding proteins by monovalent phage display. *Biochemistry* 30: 10832-7 (1991).

(56) References Cited

OTHER PUBLICATIONS

MacCallum et al., Antibody-antigen intractions: Contact analysis and binding site technology. *J. Mol. Biol.* 262: 732-45 (1996).

Mack et al., Biologic properties of a bispecific single-chain antibody directed against 17-1A (EpCAM) and CD3: tumor cell-dependent T cell stimulation and cytotoxic activity. *J. Immunol.* 158: 3965-70 (1997).

Marks et al., By-passing immunization: Human antibodies from V-gene libraries displayed on phage. *J. Mol. Biol.* 222:581-97 (1991).

Martin et al., Irreversible coupling of immunoglobulin fragments to preformed vesicles. *J. Biol. Chem.* 257: 286-8 (1982).

Martin et al., Structural families in loops of homologous proteins: automatic classification, modelling and application to antibodies. *J. Mol. Biol.* 263: 800-15 (1996).

Mather et al., Culture of testicular cells in hormone-supplemented serum-free medium. *Ann. N.Y. Acad. Sci.* 383: 44-68 (1982).

Mather, Establishment and characterization of two distinct mouse testicular epithelial cell lines. *Biol. Reprod.* 23: 243-51 (1980).

Mendez et al., Functional transplant of megabase human immunoglobulin loci recapitulates human antibody response in mice. *Nat. Genet.* 15: 146-56 (1997).

Morrison et al., Chimeric human antibody molecules: mouse antigen-binding domains with human constant region domains. *Proc. Natl. Acad. Sci. USA* 81: 6851-5 (1984).

Needleman et al., A general method applicable to the search for similarities in the amino acid sequence of two proteins. *J. Mol. Biol.* 48: 443-53 (1970).

Nolan et al., Fluorescence-activated cell analysis and sorting of viable mammalian cells based on beta-D-galactosidase activity after transduction of *Escherichia coli* lacZ. *Proc. Natl. Acad. Sci. USA* 85: 2603-7 (1988).

Olsson et al., Human-human monoclonal antibody-producing hybridomas: Technical aspects. *Meth. Enzymol.* 92: 3-16 (1982).

Owen et al., Synthesis of a functional anti-phytochrome single-chain Fv protein in transgenic tobacco. *Bio/Technology* 10: 790-4 (1992).

Pearson et al., Improved tools for biological sequence comparison. *Proc. Natl. Acad. Sci. USA* 85:2444-8 (1988).

Presta, Antibody engineering. *Curr. Op. Struct. Biol.* 2: 593-6 (1992).

Randolph et al., Surfactant-protein interactions. *Pharm. Biotechnol.* 13: 159-75 (2002).

Raum et al., Anti-self antibodies selected from a human IgD heavy chain repertoire: a novel approach to generate therapeutic human antibodies against tumor-associated differentiation antigens. *Cancer Immunol. Immunother.* 50: 141-50 (2001).

Riechmann et al., Reshaping human antibodies for therapy. *Nature,* 332: 323-9 (1988).

Schier et al., Efficient in vitro affinity maturation of phage antibodies using BIAcore guided selections. *Hum. Antibodies Hybridomas* 7(3): 97-105 (1996).

Schlereth et al., T-cell activation and B-cell depletion in chimpanzees treated with a bispecific anti-CD19/anti-CD3 single-chain antibody construct. *Cancer Immunol. Immunother.* 55: 503-14 (2006).

Sidman et al., Controlled release of macromolecules and pharmaceuticals from synthetic polypeptides based on glutamic acid. *Biopolymers* 2: 547-56 (1983).

Smith et al., Comparison of biosequences. *Adv. Appl. Math.* 2: 482-9 (1981).

Stauber et al., Development and applications of enhanced green fluorescent protein mutants. *Biotechniques* 24: 462-71 (1998).

Takeda et al., Construction of chimaeric processed immunoglobulin genes containing mouse variable and human constant region sequences. *Nature* 314: 452-4 (1985).

Thotakura et al., Enzymatic deglycosylation of glycoproteins. *Meth. Enzymol.* 138: 350-9 (1987).

Tomlinson et al., The repertoire of human germline VH sequences reveals about fifty groups of VH segments with different hypervariable loops. *J. Mol. Biol.* 227: 776-98 (1992).

Tomlinson et al., The structural repertoire of the human V kappa domain. *EMBO J.* 14: 4628-38 (1995).

Topp et al., Long-term follow-up of hematologic relapse-free survival in a phase 2 study of blinatumomab in patients with MRD in B-lineage ALL. *Blood* 120(26): 5185-7 (2012).

\* cited by examiner

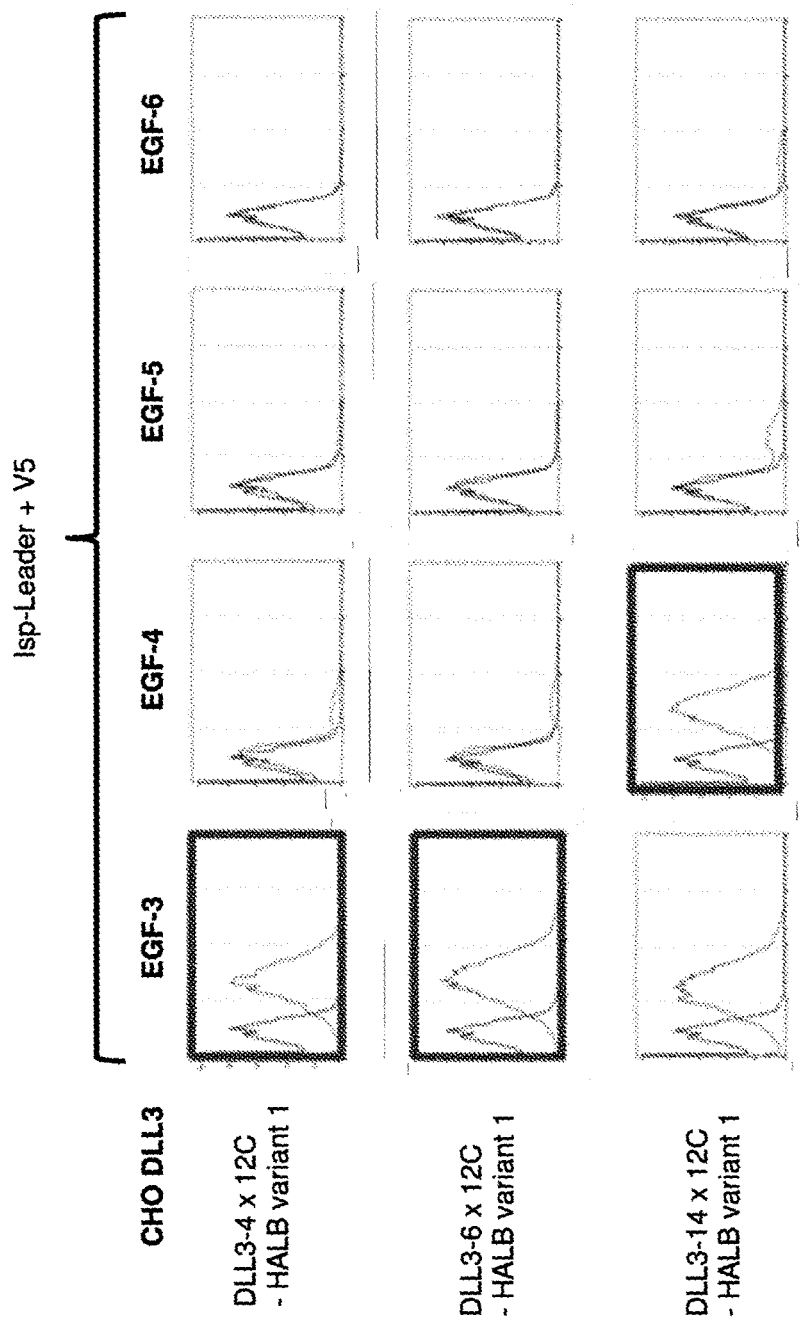

x axis - FL1-H
y axis - Count

ANTIBODY CONSTRUCTS FOR DLL3 AND CD3

The present invention relates to a bispecific antibody construct comprising a first binding domain which binds to human DLL3 on the surface of a target cell and a second binding domain which binds to human CD3 on the surface of a T cell. Moreover, the invention provides a polynucleotide encoding the antibody construct, a vector comprising said polynucleotide and a host cell transformed or transfected with said polynucleotide or vector. Furthermore, the invention provides a process for the production of the antibody construct of the invention, a medical use of said antibody construct and a kit comprising said antibody construct.

Small cell lung cancer (SCLC) is an aggressive form of lung cancer with a poor prognosis and limited therapeutic options, representing about 15% of all newly diagnosed lung cancers and equal to about 25,000 new cases in the US and 180,000 new cases worldwide per year. Survival rates have remained low for several decades, with only 5% of SCLC patients surviving five years, in a large part due to the lack of new therapies to combat this form of lung cancer. Most patients present with extensive-stage disease, while about a third of patients present with limited stage disease, defined by the presence of tumors in only one side of the chest and that fit in a single radiation field. These stages impact available therapeutic regiments, with limited stage disease treated with chemotherapy and radiation and extensive stage disease treated with chemotherapy alone. Disseminated, metastatic tumors with lymphoma-like characteristics are a hallmark of SCLC. The first known diagnosis of SCLC patients described it as a disease of the lymphatic system, not being recognized as lung cancer until 1926, which highlights some of the unique nature of SCLC tumors as compared to other solid tumors.

Patients typically respond well to the current front-line therapy, which includes etoposide and cisplatin, but invariably quickly relapse with chemoresistant disease, for which no therapeutic options are currently available. Prognosis in the relapsed refractory setting is extremely poor, with rapid disease progression and short median survival of less than six months. Furthermore, SCLC patients have high rates of comorbidities, including hypertension, cardiac disease, diabetes and paraneoplastic syndromes. These, coupled with the typically advanced age of SCLC patients, impact the ability of patients to endure harsh chemo regimens, further limiting treatment options.

A bispecific antibody modality, comprising an scFv that recognizes CD3 expressed on T cells and another scFv that recognizes a tumor-associated antigen, has shown promising efficacy in the clinic, with high response rates in hematological malignancies such as refractory B-ALL (Topp, M. S. et al. Blood, 2012. 120(26):p. 5185-5187), resulting in the approval of Blincyto. While efficacy with T cell-engaging therapies has yet to be demonstrated in a solid tumor indication, SCLC may represent a promising solid tumor indication for the CD3×tumor target bispecific antibody modality, given the disseminated nature of the disease. Therefore, a bispecific T cell engager that directs T cells against a specific tumor antigen presents a new opportunity as a new therapeutic option in the treatment of SCLC.

DLL3 was presently identified as an SCLC-specific tumor antigen by next-generation sequencing, comparing the prevalence of DLL3 mRNA in a panel of primary patient tumors and a large collection of normal tissues. The level of DLL3 expression in SCLC tumors was moderate, but highly prevalent, with approximately 90% of the tumors analyzed showing evidence of DLL3 expression by RNA-seq. In contrast to SCLC tumors, normal tissues showed very low expression of DLL3 transcript, with small levels detected in testis, optic nerve and cerebellum. Comparison of SCLC cell lines and tumors by RNA-seq showed similar expression levels, while cell surface quantitation of DLL3 expression on SCLC cell lines indicated expression levels below 5000 DLL3 per cell, with typical expression levels below 2000 DLL3/cell. Expression of DLL3 protein was confirmed by IHC, where 86% of SCLC tumors showed positive staining for DLL3, with a homogeneous and membranous staining pattern. Aside from very faint staining in cerebellum, all other normal tissues were negative for DLL3 staining.

DLL3 is a non-canonical Notch ligand, functioning in a cell autonomous manner to inhibit Notch signaling, binding to Notch in cis, thus blocking cell to cell interactions and internalization of Notch in the target cell, a hallmark of canonical Notch signaling. The primary role for DLL3 is in somitogenesis during embryonic development. Mice with DLL3 knockouts show segmental defects in the axial skeleton and cranial and neuronal development. Somitic patterning defects are also seen in humans with certain germline DLL3 mutations, resulting in a condition called spondylocostal dysostosis.

DLL3 has been proposed previously in methods to diagnose and treat glioma, in addition to SCLC, using an antibody-drug conjugate (ADC) (WO 2013/126746). Using an ADC-based approach for DLL3 may have limitations, given the low expression levels of the protein on the cell surface and the reduced performance of ADCs against targets with low expression. Furthermore, ADC molecules often demonstrate toxicity related to free warhead, likely a result of linker degradation, resulting in maximum tolerated dose limitations and potential impacts on efficacy unrelated to the target chosen for the antibody. This is less likely to be an issue for a T cell-engaging bispecific molecule, engineered to engage DLL3 and CD3 simultaneously, given the required sensitivity of T cells for their targets, and highly potent in vitro cytotoxicity has been demonstrated on cell lines expressing several hundred target proteins per cell. Additionally, the usually smaller size of a bispecific T cell engaging antibody construct relative to a normal antibody (full-length IgG) may improve tissue penetration and increase potency due to more efficient engagement of the DLL3 and CD3 targets, resulting in improved synapse formation between the T cell and target tumor cell.

SCLC remains a significant unmet medical need, and new therapeutic options are required to improve the outlook for this sizable patient population. The above discussed bispecific antibody modality is clinically validated, and as such an antibody construct targeting DLL3 and CD3 represents a promising new possibility for the treatment of SCLC and an opportunity to improve the survival of patients suffering with this indication. As there is still a need for having available further options for the treatment of tumor or cancer diseases related to the overexpression of DLL3, there are provided herewith means and methods for the solution of this problem in the form of a bispecific antibody construct with one binding domain directed to DLL3 and a second binding domain directed to CD3 on T cells.

Thus, in a first aspect, the present invention provides a bispecific antibody construct comprising a first binding domain which binds to human DLL3 on the surface of a target cell and a second binding domain which binds to human CD3 on the surface of a T cell, wherein the first binding domain binds to an epitope of DLL3 which is comprised within the region as depicted in SEQ ID NO: 260.

It must be noted that as used herein, the singular forms "a", "an", and "the" include plural references unless the context clearly indicates otherwise. Thus, for example, reference to "a reagent" includes one or more of such different reagents and reference to "the method" includes reference to equivalent steps and methods known to those of ordinary skill in the art that could be modified or substituted for the methods described herein.

Unless otherwise indicated, the term "at least" preceding a series of elements is to be understood to refer to every element in the series. Those skilled in the art will recognize, or be able to ascertain using no more than routine experimentation, many equivalents to the specific embodiments of the invention described herein. Such equivalents are intended to be encompassed by the present invention.

The term "and/or" wherever used herein includes the meaning of "and", "or" and "all or any other combination of the elements connected by said term".

The term "about" or "approximately" as used herein means within ±20%, preferably within ±15%, more preferably within ±10%, and most preferably within ±5% of a given value or range.

Throughout this specification and the claims which follow, unless the context requires otherwise, the word "comprise", and variations such as "comprises" and "comprising", will be understood to imply the inclusion of a stated integer or step or group of integers or steps but not the exclusion of any other integer or step or group of integer or step. When used herein the term "comprising" can be substituted with the term "containing" or "including" or sometimes when used herein with the term "having".

When used herein "consisting of" excludes any element, step, or ingredient not specified in the claim element. When used herein, "consisting essentially of" does not exclude materials or steps that do not materially affect the basic and novel characteristics of the claim.

In each instance herein any of the terms "comprising", "consisting essentially of" and "consisting of" may be replaced with either of the other two terms.

The term "antibody construct" refers to a molecule in which the structure and/or function is/are based on the structure and/or function of an antibody, e.g., of a full-length or whole immunoglobulin molecule. An antibody construct is hence capable of binding to its specific target or antigen. Furthermore, an antibody construct according to the invention comprises the minimum structural requirements of an antibody which allow for the target binding. This minimum requirement may e.g. be defined by the presence of at least the three light chain CDRs (i.e. CDR1, CDR2 and CDR3 of the VL region) and/or the three heavy chain CDRs (i.e. CDR1, CDR2 and CDR3 of the VH region), preferably of all six CDRs. The antibodies on which the constructs according to the invention are based include for example monoclonal, recombinant, chimeric, deimmunized, humanized and human antibodies.

Within the definition of "antibody constructs" according to the invention are full-length or whole antibodies also including camelid antibodies and other immunoglobulin antibodies generated by biotechnological or protein engineering methods or processes. These full-length antibodies may be for example monoclonal, recombinant, chimeric, deimmunized, humanized and human antibodies. Also within the definition of "antibody constructs" are fragments of full-length antibodies, such as VH, VHH, VL, (s)dAb, Fv, Fd, Fab, Fab', F(ab')2 or "r IgG" ("half antibody"). Antibody constructs according to the invention may also be modified fragments of antibodies, also called antibody variants, such as scFv, di-scFv or bi(s)-scFv, scFv-Fc, scFv-zipper, scFab, Fab2, Fab3, diabodies, single chain diabodies, tandem diabodies (Tandab's), tandem di-scFv, tandem tri-scFv, "minibodies" exemplified by a structure which is as follows: (VH-VL-CH3)2, (scFv-CH3)2, ((scFv)2-CH3+CH3), ((scFv)2-CH3) or (scFv-CH3-scFv)2, multibodies such as triabodies or tetrabodies, and single domain antibodies such as nanobodies or single variable domain antibodies comprising merely one variable domain, which might be VHH, VH or VL, that specifically bind an antigen or epitope independently of other V regions or domains. Further preferred formats of the antibody constructs according to the invention are cross bodies, maxi bodies, hetero Fc constructs and mono Fc constructs. Examples for those formats will be described herein below.

A binding domain may typically comprise an antibody light chain variable region (VL) and an antibody heavy chain variable region (VH); however, it does not have to comprise both. Fd fragments, for example, have two VH regions and often retain some antigen-binding function of the intact antigen-binding domain. Additional examples for the format of antibody fragments, antibody variants or binding domains include (1) a Fab fragment, a monovalent fragment having the VL, VH, CL and CH1 domains; (2) a F(ab')2 fragment, a bivalent fragment having two Fab fragments linked by a disulfide bridge at the hinge region; (3) an Fd fragment having the two VH and CH1 domains; (4) an Fv fragment having the VL and VH domains of a single arm of an antibody, (5) a dAb fragment (Ward et al., (1989) Nature 341:544-546), which has a VH domain; (6) an isolated complementarity determining region (CDR), and (7) a single chain Fv (scFv), the latter being preferred (for example, derived from an scFv-library). Examples for embodiments of antibody constructs according to the invention are e.g. described in WO 00/006605, WO 2005/040220, WO 2008/119567, WO 2010/037838, WO 2013/026837, WO 2013/026833, US 2014/0308285, US 2014/0302037, W O2014/144722, WO 2014/151910, and WO 2015/048272.

Furthermore, the definition of the term "antibody construct" includes monovalent, bivalent and polyvalent/multivalent constructs and, thus, monospecific constructs, specifically binding to only one antigenic structure, as well as bispecific and polyspecific/multispecific constructs, which specifically bind more than one antigenic structure, e.g. two, three or more, through distinct binding domains. Moreover, the definition of the term "antibody construct" includes molecules consisting of only one polypeptide chain as well as molecules consisting of more than one polypeptide chain, which chains can be either identical (homodimers, homotrimers or homo oligomers) or different (heterodimer, heterotrimer or heterooligomer). Examples for the above identified antibodies and variants or derivatives thereof are described inter alia in Harlow and Lane, Antibodies a laboratory manual, CSHL Press (1988) and Using Antibodies: a laboratory manual, CSHL Press (1999), Kontermann and Dübel, Antibody Engineering, Springer, 2nd ed. 2010 and Little, Recombinant Antibodies for Immunotherapy, Cambridge University Press 2009.

The antibody constructs of the present invention are preferably "in vitro generated antibody constructs". This term refers to an antibody construct according to the above definition where all or part of the variable region (e.g., at least one CDR) is generated in a non-immune cell selection, e.g., an in vitro phage display, protein chip or any other method in which candidate sequences can be tested for their ability to bind to an antigen. This term thus preferably excludes sequences generated solely by genomic rearrangement in an immune cell in an animal. A "recombinant antibody" is an antibody made through the use of recombinant DNA technology or genetic engineering.

The term "monoclonal antibody" (mAb) or monoclonal antibody construct as used herein refers to an antibody obtained from a population of substantially homogeneous antibodies, i.e., the individual antibodies comprising the population are identical except for possible naturally occurring mutations and/or post-translation modifications (e.g., isomerizations, amidations) that may be present in minor amounts. Monoclonal antibodies are highly specific, being directed against a single antigenic site or determinant on the antigen, in contrast to conventional (polyclonal) antibody preparations which typically include different antibodies directed against different determinants (or epitopes). In addition to their specificity, the monoclonal antibodies are advantageous in that they are synthesized by the hybridoma culture, hence uncontaminated by other immunoglobulins. The modifier "monoclonal" indicates the character of the antibody as being obtained from a substantially homogeneous population of antibodies, and is not to be construed as requiring production of the antibody by any particular method.

For the preparation of monoclonal antibodies, any technique providing antibodies produced by continuous cell line cultures can be used. For example, monoclonal antibodies to be used may be made by the hybridoma method first described by Koehler et al., Nature, 256: 495 (1975), or may be made by recombinant DNA methods (see, e.g., U.S. Pat. No. 4,816,567). Examples for further techniques to produce human monoclonal antibodies include the trioma technique, the human B-cell hybridoma technique (Kozbor, Immunology Today 4 (1983), 72) and the EBV-hybridoma technique (Cole et al., Monoclonal Antibodies and Cancer Therapy, Alan R. Liss, Inc. (1985), 77-96).

Hybridomas can then be screened using standard methods, such as enzyme-linked immunosorbent assay (ELISA) and surface plasmon resonance (BIACORE™) analysis, to identify one or more hybridomas that produce an antibody that specifically binds with a specified antigen. Any form of the relevant antigen may be used as the immunogen, e.g., recombinant antigen, naturally occurring forms, any variants or fragments thereof, as well as an antigenic peptide thereof. Surface plasmon resonance as employed in the BIAcore system can be used to increase the efficiency of phage antibodies which bind to an epitope of a target antigen, such as DLL3 or CD3 epsilon (Schier, Human Antibodies Hybridomas 7 (1996), 97-105; Malmborg, J. Immunol. Methods 183 (1995), 7-13).

Another exemplary method of making monoclonal antibodies includes screening protein expression libraries, e.g., phage display or ribosome display libraries. Phage display is described, for example, in Ladner et al., U.S. Pat. No. 5,223,409; Smith (1985) Science 228:1315-1317, Clackson et al., Nature, 352: 624-628 (1991) and Marks et al., J. Mol. Biol., 222: 581-597 (1991).

In addition to the use of display libraries, the relevant antigen can be used to immunize a non-human animal, e.g., a rodent (such as a mouse, hamster, rabbit or rat). In one embodiment, the non-human animal includes at least a part of a human immunoglobulin gene. For example, it is possible to engineer mouse strains deficient in mouse antibody production with large fragments of the human Ig (immunoglobulin) loci. Using the hybridoma technology, antigen-specific monoclonal antibodies derived from the genes with the desired specificity may be produced and selected. See, e.g., XENOMOUSE™, Green et al. (1994) Nature Genetics 7:13-21, US 2003-0070185, WO 96/34096, and WO 96/33735.

A monoclonal antibody can also be obtained from a non-human animal, and then modified, e.g., humanized, deimmunized, rendered chimeric etc., using recombinant DNA techniques known in the art. Examples of modified antibody constructs include humanized variants of non-human antibodies, "affinity matured" antibodies (see, e.g. Hawkins et al. J. Mol. Biol. 254, 889-896 (1992) and Lowman et al., Biochemistry 30, 10832-10837 (1991)) and antibody mutants with altered effector function(s) (see, e.g., U.S. Pat. No. 5,648,260, Kontermann and Dübel (2010), loc. cit. and Little (2009), loc. cit.).

In immunology, affinity maturation is the process by which B cells produce antibodies with increased affinity for antigen during the course of an immune response. With repeated exposures to the same antigen, a host will produce antibodies of successively greater affinities. Like the natural prototype, the in vitro affinity maturation is based on the principles of mutation and selection. The in vitro affinity maturation has successfully been used to optimize antibodies, antibody constructs, and antibody fragments. Random mutations inside the CDRs are introduced using radiation, chemical mutagens or error-prone PCR. In addition, the genetical diversity can be increased by chain shuffling. Two or three rounds of mutation and selection using display methods like phage display usually results in antibody fragments with affinities in the low nanomolar range.

A preferred type of an amino acid substitutional varianation of the antibody constructs involves substituting one or more hypervariable region residues of a parent antibody (e. g. a humanized or human antibody). Generally, the resulting variant(s) selected for further development will have improved biological properties relative to the parent antibody from which they are generated. A convenient way for generating such substitutional variants involves affinity maturation using phage display. Briefly, several hypervariable region sites (e. g. 6-7 sites) are mutated to generate all possible amino acid substitutions at each site. The antibody variants thus generated are displayed in a monovalent fashion from filamentous phage particles as fusions to the gene III product of M13 packaged within each particle. The phage-displayed variants are then screened for their biological activity (e. g. binding affinity) as herein disclosed. In order to identify candidate hypervariable region sites for modification, alanine scanning mutagenesis can be performed to identify hypervariable region residues contributing significantly to antigen binding. Alternatively, or additionally, it may be beneficial to analyze a crystal structure of the antigen-antibody complex to identify contact points between the binding domain and, e.g., human DLL3. Such contact residues and neighbouring residues are candidates for substitution according to the techniques elaborated herein. Once such variants are generated, the panel of variants is subjected to screening as described herein and antibodies with superior properties in one or more relevant assays may be selected for further development.

The monoclonal antibodies and antibody constructs of the present invention specifically include "chimeric" antibodies (immunoglobulins) in which a portion of the heavy and/or light chain is identical with or homologous to corresponding sequences in antibodies derived from a particular species or belonging to a particular antibody class or subclass, while the remainder of the chain(s) is/are identical with or homologous to corresponding sequences in antibodies derived from another species or belonging to another antibody class or subclass, as well as fragments of such antibodies, so long as they exhibit the desired biological activity (U.S. Pat. No. 4,816,567; Morrison et al., Proc. Natl. Acad. Sci. USA, 81: 6851-6855 (1984)). Chimeric antibodies of interest herein include "primitized" antibodies comprising variable domain antigen-binding sequences derived from a non-human primate (e.g., Old World Monkey, Ape etc.) and human constant region sequences. A variety of approaches for making chimeric antibodies have been described. See e.g., Morrison et al., Proc. Natl. Acad. ScL U.S.A. 81:6851, 1985; Takeda et al., Nature 314:452, 1985, Cabilly et al., U.S. Pat. No. 4,816,567; Boss et al., U.S. Pat. No. 4,816,397; Tanaguchi et al., EP 0171496; EP 0173494; and GB 2177096.

An antibody, antibody construct, antibody fragment or antibody variant may also be modified by specific deletion of human T cell epitopes (a method called "deimmunization") by the methods disclosed for example in WO 98/52976 or WO 00/34317. Briefly, the heavy and light chain variable domains of an antibody can be analyzed for peptides that bind to MHC class II; these peptides represent potential T cell epitopes (as defined in WO 98/52976 and WO 00/34317). For detection of potential T cell epitopes, a computer modeling approach termed "peptide threading" can be applied, and in addition a database of human MHC class II binding peptides can be searched for motifs present in the VH and VL sequences, as described in WO 98/52976 and WO 00/34317. These motifs bind to any of the 18 major MHC class II DR allotypes, and thus constitute potential T cell epitopes. Potential T cell epitopes detected can be eliminated by substituting small numbers of amino acid residues in the variable domains, or preferably, by single amino acid substitutions. Typically, conservative substitutions are made. Often, but not exclusively, an amino acid common to a position in human germline antibody sequences may be used. Human germline sequences are disclosed e.g. in Tomlinson, et al. (1992) J. Mol. Biol. 227:776-798; Cook, G. P. et al. (1995) Immunol. Today Vol. 16 (5): 237-242; and Tomlinson et al. (1995) EMBO J. 14: 14:4628-4638. The V BASE directory provides a comprehensive directory of human immunoglobulin variable region sequences (compiled by Tomlinson, L A. et al. MRC Centre for Protein Engineering, Cambridge, UK). These sequences can be used as a source of human sequence, e.g., for framework regions and CDRs. Consensus human framework regions can also be used, for example as described in U.S. Pat. No. 6,300,064.

"Humanized" antibodies, antibody constructs, variants or fragments thereof (such as Fv, Fab, Fab', F(ab')2 or other antigen-binding subsequences of antibodies) are antibodies or immunoglobulins of mostly human sequences, which contain (a) minimal sequence(s) derived from non-human immunoglobulin. For the most part, humanized antibodies are human immunoglobulins (recipient antibody) in which residues from a hypervariable region (also CDR) of the recipient are replaced by residues from a hypervariable region of a non-human (e.g., rodent) species (donor antibody) such as mouse, rat, hamster or rabbit having the desired specificity, affinity, and capacity. In some instances, Fv framework region (FR) residues of the human immunoglobulin are replaced by corresponding non-human residues. Furthermore, "humanized antibodies" as used herein may also comprise residues which are found neither in the recipient antibody nor the donor antibody. These modifications are made to further refine and optimize antibody performance. The humanized antibody may also comprise at least a portion of an immunoglobulin constant region (Fc), typically that of a human immunoglobulin. For further details, see Jones et al., Nature, 321: 522-525 (1986); Reichmann et al., Nature, 332: 323-329 (1988); and Presta, Curr. Op. Struct. Biol., 2: 593-596 (1992).

Humanized antibodies or fragments thereof can be generated by replacing sequences of the Fv variable domain that are not directly involved in antigen binding with equivalent sequences from human Fv variable domains. Exemplary methods for generating humanized antibodies or fragments thereof are provided by Morrison (1985) Science 229:1202-1207; by Oi et al. (1986) BioTechniques 4:214; and by U.S. Pat. Nos. 5,585,089; 5,693,761; 5,693,762; 5,859,205; and 6,407,213. Those methods include isolating, manipulating, and expressing the nucleic acid sequences that encode all or part of immunoglobulin Fv variable domains from at least one of a heavy or light chain. Such nucleic acids may be obtained from a hybridoma producing an antibody against a predetermined target, as described above, as well as from other sources. The recombinant DNA encoding the humanized antibody molecule can then be cloned into an appropriate expression vector.

Humanized antibodies may also be produced using transgenic animals such as mice that express human heavy and light chain genes, but are incapable of expressing the endogenous mouse immunoglobulin heavy and light chain genes. Winter describes an exemplary CDR grafting method that may be used to prepare the humanized antibodies described herein (U.S. Pat. No. 5,225,539). All of the CDRs of a particular human antibody may be replaced with at least a portion of a non-human CDR, or only some of the CDRs may be replaced with non-human CDRs. It is only necessary to replace the number of CDRs required for binding of the humanized antibody to a predetermined antigen.

A humanized antibody can be optimized by the introduction of conservative substitutions, consensus sequence substitutions, germline substitutions and/or back mutations. Such altered immunoglobulin molecules can be made by any of several techniques known in the art, (e.g., Teng et al., Proc. Natl. Acad. Sci. U.S.A., 80: 7308-7312, 1983; Kozbor et al., Immunology Today, 4: 7279, 1983; Olsson et al., Meth. Enzymol., 92: 3-16, 1982, and EP 239 400).

The term "human antibody", "human antibody construct" and "human binding domain" includes antibodies, antibody constructs and binding domains having antibody regions such as variable and constant regions or domains which correspond substantially to human germline immunoglobulin sequences known in the art, including, for example, those described by Kabat et al. (1991) (loc. cit.). The human antibodies, antibody constructs or binding domains of the invention may include amino acid residues not encoded by human germline immunoglobulin sequences (e.g., mutations introduced by random or site-specific mutagenesis in vitro or by somatic mutation in vivo), for example in the CDRs, and in particular, in CDR3. The human antibodies, antibody constructs or binding domains can have at least one, two, three, four, five, or more positions replaced with an amino acid residue that is not encoded by the human germline immunoglobulin sequence. The definition of human antibodies, antibody constructs and binding domains as used herein also contemplates fully human antibodies, which include only non-artificially and/or genetically altered human sequences of antibodies as those can be derived by using technologies or systems such as the Xenomouse.

In some embodiments, the antibody constructs of the invention are "isolated" or "substantially pure" antibody constructs. "Isolated" or "substantially pure", when used to describe the antibody constructs disclosed herein, means an antibody construct that has been identified, separated and/or recovered from a component of its production environment. Preferably, the antibody construct is free or substantially free of association with all other components from its production environment. Contaminant components of its production environment, such as that resulting from recombinant transfected cells, are materials that would typically interfere with diagnostic or therapeutic uses for the polypeptide, and may include enzymes, hormones, and other proteinaceous or non-proteinaceous solutes. The antibody constructs may e.g constitute at least about 5%, or at least about 50% by weight of the total protein in a given sample. It is understood that the isolated protein may constitute from 5% to 99.9% by weight of the total protein content, depending on the circumstances. The polypeptide may be made at a significantly higher concentration through the use of an inducible promoter or high expression promoter, such that it is made at increased concentration levels. The definition includes the production of an antibody construct in a wide variety of organisms and/or host cells that are known in the art. In preferred embodiments, the antibody construct will be purified (1) to a degree sufficient to obtain at least 15 residues of N-terminal or internal amino acid sequence by use of a spinning cup sequenator, or (2) to homogeneity by SDS-PAGE under non-reducing or reducing conditions using Coomassie blue or, preferably, silver stain. Ordinarily, however, an isolated antibody construct will be prepared by at least one purification step.

The term "binding domain" characterizes in connection with the present invention a domain which (specifically) binds to/interacts with/recognizes a given target epitope or a given target site on the target molecules (antigens), here: DLL3 and CD3, respectively. The structure and function of the first binding domain (recognizing DLL3), and preferably also the structure and/or function of the second binding domain (recognizing CD3), is/are based on the structure and/or function of an antibody, e.g. of a full-length or whole immunoglobulin molecule. According to the invention, the first binding domain is characterized by the presence of three light chain CDRs (i.e. CDR1, CDR2 and CDR3 of the VL region) and/or three heavy chain CDRs (i.e. CDR1, CDR2 and CDR3 of the VH region). The second binding domain preferably also comprises the minimum structural requirements of an antibody which allow for the target binding. More preferably, the second binding domain comprises at least three light chain CDRs (i.e. CDR1, CDR2 and CDR3 of the VL region) and/or three heavy chain CDRs (i.e. CDR1, CDR2 and CDR3 of the VH region). It is envisaged that the first and/or second binding domain is produced by or obtainable by phage-display or library screening methods rather than by grafting CDR sequences from a pre-existing (monoclonal) antibody into a scaffold.

According to the present invention, binding domains are in the form of one or more polypeptides. Such polypeptides may include proteinaceous parts and non-proteinaceous parts (e.g. chemical linkers or chemical cross-linking agents such as glutaraldehyde). Proteins (including fragments thereof, preferably biologically active fragments, and peptides, usually having less than 30 amino acids) comprise two or more amino acids coupled to each other via a covalent peptide bond (resulting in a chain of amino acids). The term "polypeptide" as used herein describes a group of molecules, which usually consist of more than 30 amino acids. Polypeptides may further form multimers such as dimers, trimers and higher oligomers, i.e., consisting of more than one polypeptide molecule. Polypeptide molecules forming such dimers, trimers etc. may be identical or non-identical. The corresponding higher order structures of such multimers are, consequently, termed homo- or heterodimers, homo- or heterotrimers etc. An example for a hereteromultimer is an antibody molecule, which, in its naturally occurring form, consists of two identical light polypeptide chains and two identical heavy polypeptide chains. The terms "peptide", "polypeptide" and "protein" also refer to naturally modified peptides/polypeptides/proteins wherein the modification is effected e.g. by post-translational modifications like glycosylation, acetylation, phosphorylation and the like. A "peptide", "polypeptide" or "protein" when referred to herein may also be chemically modified such as pegylated. Such modifications are well known in the art and described herein below.

Preferably the binding domain which binds to DLL3 and/or the binding domain which binds to CD3 is/are human binding domains. Antibodies and antibody constructs comprising at least one human binding domain avoid some of the problems associated with antibodies or antibody constructs that possess non-human such as rodent (e.g. murine, rat, hamster or rabbit) variable and/or constant regions. The presence of such rodent derived proteins can lead to the rapid clearance of the antibodies or antibody constructs or can lead to the generation of an immune response against the antibody or antibody construct by a patient. In order to avoid the use of rodent derived antibodies or antibody constructs, human or fully human antibodies/antibody constructs can be generated through the introduction of human antibody function into a rodent so that the rodent produces fully human antibodies.

The ability to clone and reconstruct megabase-sized human loci in YACs and to introduce them into the mouse germline provides a powerful approach to elucidating the functional components of very large or crudely mapped loci as well as generating useful models of human disease. Furthermore, the use of such technology for substitution of mouse loci with their human equivalents could provide unique insights into the expression and regulation of human gene products during development, their communication with other systems, and their involvement in disease induction and progression.

An important practical application of such a strategy is the "humanization" of the mouse humoral immune system. Introduction of human immunoglobulin (Ig) loci into mice in which the endogenous Ig genes have been inactivated offers the opportunity to study the mechanisms underlying programmed expression and assembly of antibodies as well as their role in B-cell development. Furthermore, such a strategy could provide an ideal source for production of fully human monoclonal antibodies (mAbs)—an important milestone towards fulfilling the promise of antibody therapy in human disease. Fully human antibodies or antibody constructs are expected to minimize the immunogenic and allergic responses intrinsic to mouse or mouse-derivatized mAbs and thus to increase the efficacy and safety of the administered antibodies/antibody constructs. The use of fully human antibodies or antibody constructs can be expected to provide a substantial advantage in the treatment of chronic and recurring human diseases, such as inflammation, autoimmunity, and cancer, which require repeated compound administrations.

One approach towards this goal was to engineer mouse strains deficient in mouse antibody production with large fragments of the human Ig loci in anticipation that such mice would produce a large repertoire of human antibodies in the absence of mouse antibodies. Large human Ig fragments would preserve the large variable gene diversity as well as the proper regulation of antibody production and expression. By exploiting the mouse machinery for antibody diversification and selection and the lack of immunological tolerance to human proteins, the reproduced human antibody repertoire in these mouse strains should yield high affinity antibodies against any antigen of interest, including human antigens. Using the hybridoma technology, antigen-specific human mAbs with the desired specificity could be readily produced and selected. This general strategy was demonstrated in connection with the generation of the first Xeno-Mouse mouse strains (see Green et al. Nature Genetics 7:13-21 (1994)). The XenoMouse strains were engineered with yeast artificial chromosomes (YACs) containing 245 kb and 190 kb-sized germline configuration fragments of the human heavy chain locus and kappa light chain locus, respectively, which contained core variable and constant region sequences. The human Ig containing YACs proved to be compatible with the mouse system for both rearrangement and expression of antibodies and were capable of substituting for the inactivated mouse Ig genes. This was demonstrated by their ability to induce B cell development, to produce an adult-like human repertoire of fully human antibodies, and to generate antigen-specific human mAbs. These results also suggested that introduction of larger portions of the human Ig loci containing greater numbers of V genes, additional regulatory elements, and human Ig constant regions might recapitulate substantially the full repertoire that is characteristic of the human humoral response to infection and immunization. The work of Green et al. was recently extended to the introduction of greater than approximately 80% of the human antibody repertoire through introduction of megabase sized, germline configuration YAC fragments of the human heavy chain loci and kappa light chain loci, respectively. See Mendez et al. Nature Genetics 15:146-156 (1997) and U.S. patent application Ser. No. 08/759,620.

The production of the XenoMouse mice is further discussed and delineated in U.S. patent application Ser. No. 07/466,008, Ser. No. 07/610,515, Ser. No. 07/919,297, Ser. No. 07/922,649, Ser. No. 08/031,801, Ser. No. 08/112,848, Ser. No. 08/234,145, Ser. No. 08/376,279, Ser. No. 08/430,938, Ser. No. 08/464,584, Ser. No. 08/464,582, Ser. No. 08/463,191, Ser. No. 08/462,837, Ser. No. 08/486,853, Ser. No. 08/486,857, Ser. No. 08/486,859, Ser. No. 08/462,513, Ser. No. 08/724,752, and Ser. No. 08/759,620; and U.S. Pat. Nos. 6,162,963; 6,150,584; 6,114,598; 6,075,181, and 5,939,598 and Japanese Patent Nos. 3 068 180 B2, 3 068 506 B2, and 3 068 507 B2. See also Mendez et al. Nature Genetics 15:146-156 (1997) and Green and Jakobovits J. Exp. Med. 188:483-495 (1998), EP 0 463 151 B1, WO 94/02602, WO 96/34096, WO 98/24893, WO 00/76310, and WO 03/47336.

In an alternative approach, others, including GenPharm International, Inc., have utilized a "minilocus" approach. In the minilocus approach, an exogenous Ig locus is mimicked through the inclusion of pieces (individual genes) from the Ig locus. Thus, one or more VH genes, one or more DH genes, one or more JH genes, a mu constant region, and a second constant region (preferably a gamma constant region) are formed into a construct for insertion into an animal. This approach is described in U.S. Pat. No. 5,545,807 to Surani et al. and U.S. Pat. Nos. 5,545,806; 5,625,825; 5,625,126; 5,633,425; 5,661,016; 5,770,429; 5,789,650; 5,814,318; 5,877,397; 5,874,299; and 6,255,458 each to Lonberg and Kay, U.S. Pat. Nos. 5,591,669 and 6,023.010 to Krimpenfort and Berns, U.S. Pat. Nos. 5,612,205; 5,721,367; and U.S. Pat. No. 5,789,215 to Berns et al., and U.S. Pat. No. 5,643,763 to Choi and Dunn, and GenPharm International U.S. patent application Ser. No. 07/574,748, Ser. No. 07/575,962, Ser. No. 07/810,279, Ser. No. 07/853,408, Ser. No. 07/904,068, Ser. No. 07/990,860, Ser. No. 08/053,131, Ser. No. 08/096,762, Ser. No. 08/155,301, Ser. No. 08/161,739, Ser. No. 08/165,699, Ser. No. 08/209,741. See also EP 0 546 073 B1, WO 92/03918, WO 92/22645, WO 92/22647, WO 92/22670, WO 93/12227, WO 94/00569, WO 94/25585, WO 96/14436, WO 97/13852, and WO 98/24884 and U.S. Pat. No. 5,981,175. See further Taylor et al. (1992), Chen et al. (1993), Tuaillon et al. (1993), Choi et al. (1993), Lonberg et al. (1994), Taylor et al. (1994), and Tuaillon et al. (1995), Fishwild et al. (1996).

Kirin has also demonstrated the generation of human antibodies from mice in which, through microcell fusion, large pieces of chromosomes, or entire chromosomes, have been introduced. See European Patent Application Nos. 773 288 and 843 961. Xenerex Biosciences is developing a technology for the potential generation of human antibodies. In this technology, SCID mice are reconstituted with human lymphatic cells, e.g., B and/or T cells. Mice are then immunized with an antigen and can generate an immune response against the antigen. See U.S. Pat. Nos. 5,476,996; 5,698,767; and 5,958,765.

Human anti-mouse antibody (HAMA) responses have led the industry to prepare chimeric or otherwise humanized antibodies. It is however expected that certain human anti-chimeric antibody (HACA) responses will be observed, particularly in chronic or multi-dose utilizations of the antibody. Thus, it would be desirable to provide antibody constructs comprising a human binding domain against DLL3 and/or a human binding domain against CD3 in order to vitiate concerns and/or effects of HAMA or HACA response.

The terms "(specifically) binds to", "(specifically) recognizes", "is (specifically) directed to", and "(specifically) reacts with" mean in accordance with this invention that a binding domain interacts or specifically interacts with a given epitope or a given target site on the target molecules (antigens), here: DLL3 and CD3, respectively.

The term "epitope" refers to a site on an antigen to which a binding domain, an antibody or immunoglobulin, or a derivative, fragment or variant of an antibody or an immunoglobulin, specifically binds. An "epitope" is antigenic and thus the term epitope is sometimes also referred to herein as "antigenic structure" or "antigenic determinant". Thus, the binding domain is an "antigen interaction site". Said binding/interaction is also understood to define a "specific recognition".

"Epitopes" can be formed both by contiguous amino acids or non-contiguous amino acids juxtaposed by tertiary folding of a protein. A "linear epitope" is an epitope where an amino acid primary sequence comprises the recognized epitope. A linear epitope typically includes at least 3 or at least 4, and more usually, at least 5 or at least 6 or at least 7, for example, about 8 to about 10 amino acids in a unique sequence.

A "conformational epitope", in contrast to a linear epitope, is an epitope wherein the primary sequence of the amino acids comprising the epitope is not the sole defining component of the epitope recognized (e.g., an epitope wherein the primary sequence of amino acids is not necessarily recognized by the binding domain). Typically a conformational epitope comprises an increased number of amino acids relative to a linear epitope. With regard to recognition of conformational epitopes, the binding domain recognizes a three-dimensional structure of the antigen, preferably a peptide or protein or fragment thereof (in the context of the present invention, the antigenic structure for the first binding domain is comprised within the DLL3 protein). For example, when a protein molecule folds to form a three-dimensional structure, certain amino acids and/or the polypeptide backbone forming the conformational epitope become juxtaposed enabling the antibody to recognize the epitope. Methods of determining the conformation of epitopes include, but are not limited to, x-ray crystallography, two-dimensional nuclear magnetic resonance (2D-NMR) spectroscopy and site-directed spin labelling and electron paramagnetic resonance (EPR) spectroscopy.

A method for epitope mapping is described in the following: When a region (a contiguous amino acid stretch) in the human DLL3 protein is exchanged/replaced with its corresponding region of a non-human and non-primate DLL3 antigen (e.g., mouse DLL3, but others like chicken, rat, hamster, rabbit etc. might also be conceivable), a decrease in the binding of the binding domain is expected to occur, unless the binding domain is cross-reactive for the non-human, non-primate DLL3 used. Said decrease is preferably at least 10%, 20%, 30%, 40%, or 50%; more preferably at least 60%, 70%, or 80%, and most preferably 90%, 95% or even 100% in comparison to the binding to the respective region in the human DLL3 protein, whereby binding to the respective region in the human DLL3 protein is set to be 100%. It is envisaged that the aforementioned human DLL3/non-human DLL3 chimeras are expressed in CHO cells. It is also envisaged that the human DLL3/non-human DLL3 chimeras are fused with a transmembrane domain and/or cytoplasmic domain of a different membrane-bound protein such as EpCAM.

In an alternative or additional method for epitope mapping, several truncated versions of the human DLL3 extracellular domain can be generated in order to determine a specific region that is recognized by a binding domain. In these truncated versions, the different extracellular DLL3 domains/sub-domains or regions are stepwise deleted, starting from the N-terminus. The truncated DLL3 versions that were generated and used in the context of the present invention are depicted in FIG. 1. It is envisaged that the truncated DLL3 versions are expressed in CHO cells. It is also envisaged that the truncated DLL3 versions are fused with a transmembrane domain and/or cytoplasmic domain of a different membrane-bound protein such as EpCAM. It is also envisaged that the truncated DLL3 versions encompass a signal peptide domain at their N-terminus, for example a signal peptide derived from mouse IgG heavy chain signal peptide. It is furthermore envisaged that the truncated DLL3 versions encompass a v5 domain at their N-terminus (following the signal peptide) which allows verifying their correct expression on the cell surface. A decrease or a loss of binding is expected to occur with those truncated DLL3 versions which do not encompass any more the DLL3 region that is recognized by the binding domain. The decrease of binding is preferably at least 10%, 20%, 30%, 40%, 50%; more preferably at least 60%, 70%, 80%, and most preferably 90%, 95% or even 100%, whereby binding to the entire human DLL3 protein (or its extracellular region or domain) is set to be 100%. A method to test this loss of binding is described in Example 2.

A further method to determine the contribution of a specific residue of a target antigen to the recognition by a antibody construct or binding domain is alanine scanning (see e.g. Morrison K L & Weiss G A. Cur Opin Chem Biol. 2001 June; 5(3):302-7), where each residue to be analyzed is replaced by alanine, e.g. via site-directed mutagenesis. Alanine is used because of its non-bulky, chemically inert, methyl functional group that nevertheless mimics the secondary structure references that many of the other amino acids possess. Sometimes bulky amino acids such as valine or leucine can be used in cases where conservation of the size of mutated residues is desired. Alanine scanning is a mature technology which has been used for a long period of time.

The interaction between the binding domain and the epitope or the region comprising the epitope implies that a binding domain exhibits appreciable affinity for the epitope/the region comprising the epitope on a particular protein or antigen (here: DLL3 and CD3, respectively) and, generally, does not exhibit significant reactivity with proteins or antigens other than DLL3 or CD3. "Appreciable affinity" includes binding with an affinity of about $10^{-6}$ M (KD) or stronger. Preferably, binding is considered specific when the binding affinity is about $10^{-12}$ to $10^{-8}$ M, $10^{-12}$ to $10^{-9}$ M, $10^{-12}$ to $10^{-10}$ M, $10^{-11}$ to $10^{-8}$ M, preferably of about $10^{-11}$ to $10^{-8}$ M. Whether a binding domain specifically reacts with or binds to a target can be tested readily by, inter alia, comparing the reaction of said binding domain with a target protein or antigen with the reaction of said binding domain with proteins or antigens other than DLL3 or CD3. Preferably, a binding domain of the invention does not essentially or substantially bind to proteins or antigens other than DLL3 or CD3 (i.e., the first binding domain is not capable of binding to proteins other than DLL3 and the second binding domain is not capable of binding to proteins other than CD3).

The term "does not essentially/substantially bind" or "is not capable of binding" means that a binding domain of the present invention does not bind a protein or antigen other than DLL3 or CD3, i.e., does not show reactivity of more than 30%, preferably not more than 20%, more preferably not more than 10%, particularly preferably not more than 9%, 8%, 7%, 6% or 5% with proteins or antigens other than DLL3 or CD3, whereby binding to DLL3 or CD3, respectively, is set to be 100%.

It is also envisaged that the antibody constructs of the present invention bind to a human DLL3 isoform having one or both of the following DLL3 point mutations: F172C and L218P. See Example 5.

Specific binding is believed to be effected by specific motifs in the amino acid sequence of the binding domain and the antigen. Thus, binding is achieved as a result of their primary, secondary and/or tertiary structure as well as the result of secondary modifications of said structures. The specific interaction of the antigen-interaction-site with its specific antigen may result in a simple binding of said site to the antigen. Moreover, the specific interaction of the antigen-interaction-site with its specific antigen may alternatively or additionally result in the initiation of a signal, e.g. due to the induction of a change of the conformation of the antigen, an oligomerization of the antigen, etc.

The antibody constructs according to the invention bind to an epitope of DLL3 which is comprised within the region as depicted in SEQ ID NO: 260, corresponding to an amino acid stretch encompassing the regions EGF-3 and EGF-4. Other groups of anti-DLL3 binders were also generated and their DLL3 binding specificities were identified during epitope mapping (see Example 2).

The largest group of generated binders recognized an epitope within the DSL domain. However, none of those antibody constructs fulfilled the criteria for sufficient cytotoxic activity in an initial 18-hour $^{51}$Cr-based cytotoxicity assay with stimulated human CD8+ T cells as effector cells and hu DLL3 transfected CHO cells as target cells.

In a further initial 48 hour FACS-based cytotoxicity assay (using unstimulated human PBMC as effector cells and hu DLL3 transfected CHO cells as target cells), those binders that recognized a DLL3 epitope within the N-terminus of the protein had EC50 values between 1455 and 1580 pM. In the present context, these values are not considered adequate for bispecific antibodies that are provided for a therapeutic use in directing a patient's immune system, more specifically the T cells' cytotoxic activity, against cancer cells.

Finally, another group of binders was generated and characterized for its cytotoxic activity in a variety of assays. The epitope mapping of these binders revealed a specificity for a DLL3 epitope comprised within the EGF-5 region, and to some extend also within the EGF-6 region (for details, see Example 2). An overall view of the data generated in the different cytotoxicity assays (see Examples 8.3, 8.5, 8.6 and 8.7) for these binders denominated DLL3-18, DLL3-19, DLL3-20 and DLL3-21 revealed the following: While not all of the binders fail in all of the assays in terms of favorable EC50 values, the entire group clearly underperforms if compared with the antibody constructs according to the invention. This observation is highlighted with a darker shadowing of the results shown in Tables 6-9.

In summary, it can clearly be stated that the antibody constructs according to the invention (which bind to an epitope of DLL3 comprised within the region as depicted in SEQ ID NO: 260) show by far the best activity performance compared to a variety of other groups of DLL3 binders having different epitope specificities. In other words, the antibody constructs according to the invention present with a favorable epitope-activity relationship, hence supporting potent bispecific antibody construct mediated cytotoxic activity.

In another aspect, the present invention provides a bispecific antibody construct comprising a first binding domain which binds to human DLL3 on the surface of a target cell and a second binding domain which binds to human CD3 on the surface of a T cell, wherein the first binding domain binds to an epitope of DLL3 which is comprised within the region as depicted in SEQ ID NO: 258.

Preferably, the first binding domain of the bispecific antibody construct of the invention comprises a VH region comprising CDR-H1, CDR-H2 and CDR-H3 and a VL region comprising CDR-L1, CDR-L2 and CDR-L3 selected from the group consisting of:

a) CDR-H1 as depicted in SEQ ID NO: 31, CDR-H2 as depicted in SEQ ID NO: 32, CDR-H3 as depicted in SEQ ID NO: 33, CDR-L1 as depicted in SEQ ID NO: 34, CDR-L2 as depicted in SEQ ID NO: 35 and CDR-L3 as depicted in SEQ ID NO: 36;

b) CDR-H1 as depicted in SEQ ID NO: 41, CDR-H2 as depicted in SEQ ID NO: 42, CDR-H3 as depicted in SEQ ID NO: 43, CDR-L1 as depicted in SEQ ID NO: 44, CDR-L2 as depicted in SEQ ID NO: 45 and CDR-L3 as depicted in SEQ ID NO: 46;

c) CDR-H1 as depicted in SEQ ID NO: 51, CDR-H2 as depicted in SEQ ID NO: 52, CDR-H3 as depicted in SEQ ID NO: 53, CDR-L1 as depicted in SEQ ID NO: 54, CDR-L2 as depicted in SEQ ID NO: 55 and CDR-L3 as depicted in SEQ ID NO: 56;

d) CDR-H1 as depicted in SEQ ID NO: 61, CDR-H2 as depicted in SEQ ID NO: 62, CDR-H3 as depicted in SEQ ID NO: 63, CDR-L1 as depicted in SEQ ID NO: 64, CDR-L2 as depicted in SEQ ID NO: 65 and CDR-L3 as depicted in SEQ ID NO: 66;

e) CDR-H1 as depicted in SEQ ID NO: 71, CDR-H2 as depicted in SEQ ID NO: 72, CDR-H3 as depicted in SEQ ID NO: 73, CDR-L1 as depicted in SEQ ID NO: 74, CDR-L2 as depicted in SEQ ID NO: 75 and CDR-L3 as depicted in SEQ ID NO: 76;

f) CDR-H1 as depicted in SEQ ID NO: 81, CDR-H2 as depicted in SEQ ID NO: 82, CDR-H3 as depicted in SEQ ID NO: 83, CDR-L1 as depicted in SEQ ID NO: 84, CDR-L2 as depicted in SEQ ID NO: 85 and CDR-L3 as depicted in SEQ ID NO: 86;

g) CDR-H1 as depicted in SEQ ID NO: 91, CDR-H2 as depicted in SEQ ID NO: 92, CDR-H3 as depicted in SEQ ID NO: 93, CDR-L1 as depicted in SEQ ID NO: 94, CDR-L2 as depicted in SEQ ID NO: 95 and CDR-L3 as depicted in SEQ ID NO: 96;

h) CDR-H1 as depicted in SEQ ID NO: 101, CDR-H2 as depicted in SEQ ID NO: 102, CDR-H3 as depicted in SEQ ID NO: 103, CDR-L1 as depicted in SEQ ID NO: 104, CDR-L2 as depicted in SEQ ID NO: 105 and CDR-L3 as depicted in SEQ ID NO: 106; and i) CDR-H1 as depicted in SEQ ID NO: 111, CDR-H2 as depicted in SEQ ID NO: 112, CDR-H3 as depicted in SEQ ID NO: 113, CDR-L1 as depicted in SEQ ID NO: 114, CDR-L2 as depicted in SEQ ID NO: 115 and CDR-L3 as depicted in SEQ ID NO: 116.

The term "variable" refers to the portions of the antibody or immunoglobulin domains that exhibit variability in their sequence and that are involved in determining the specificity and binding affinity of a particular antibody (i.e., the "variable domain(s)"). The pairing of a variable heavy chain (VH) and a variable light chain (VL) together forms a single antigen-binding site.

Variability is not evenly distributed throughout the variable domains of antibodies; it is concentrated in sub-domains of each of the heavy and light chain variable regions. These sub-domains are called "hypervariable regions" or "complementarity determining regions" (CDRs). The more conserved (i.e., non-hypervariable) portions of the variable domains are called the "framework" regions (FRM or FR) and provide a scaffold for the six CDRs in three dimensional space to form an antigen-binding surface. The variable domains of naturally occurring heavy and light chains each comprise four FRM regions (FR1, FR2, FR3, and FR4), largely adopting a β-sheet configuration, connected by three hypervariable regions, which form loops connecting, and in some cases forming part of, the β-sheet structure. The hypervariable regions in each chain are held together in close proximity by the FRM and, with the hypervariable regions from the other chain, contribute to the formation of the antigen-binding site (see Kabat et al., loc. cit.).

The terms "CDR", and its plural "CDRs", refer to the complementarity determining region of which three make up the binding character of a light chain variable region (CDR-L1, CDR-L2 and CDR-L3) and three make up the binding character of a heavy chain variable region (CDR-H1, CDR-H2 and CDR-H3). CDRs contain most of the residues responsible for specific interactions of the antibody with the antigen and hence contribute to the functional activity of an antibody molecule: they are the main determinants of antigen specificity.

The exact definitional CDR boundaries and lengths are subject to different classification and numbering systems. CDRs may therefore be referred to by Kabat, Chothia, contact or any other boundary definitions, including the numbering system described herein. Despite differing boundaries, each of these systems has some degree of overlap in what constitutes the so called "hypervariable regions" within the variable sequences. CDR definitions according to these systems may therefore differ in length and boundary areas with respect to the adjacent framework region. See for example Kabat (an approach based on cross-species sequence variability), Chothia (an approach based on crystallographic studies of antigen-antibody complexes), and/or MacCallum (Kabat et al., loc. cit.; Chothia et al., J. Mol. Biol, 1987, 196: 901-917; and MacCallum et al., J. Mol. Biol, 1996, 262: 732). Still another standard for characterizing the antigen binding site is the AbM definition used by Oxford Molecular's AbM antibody modeling software. See, e.g., Protein Sequence and Structure Analysis of Antibody Variable Domains. In: Antibody Engineering Lab Manual (Ed.: Duebel, S. and Kontermann, R., Springer-Verlag, Heidelberg). To the extent that two residue identification techniques define regions of overlapping, but not identical regions, they can be combined to define a hybrid CDR. However, the numbering in accordance with the so-called Kabat system is preferred.

Typically, CDRs form a loop structure that can be classified as a canonical structure. The term "canonical structure" refers to the main chain conformation that is adopted by the antigen binding (CDR) loops. From comparative structural studies, it has been found that five of the six antigen binding loops have only a limited repertoire of available conformations. Each canonical structure can be characterized by the torsion angles of the polypeptide backbone. Correspondent loops between antibodies may, therefore, have very similar three dimensional structures, despite high amino acid sequence variability in most parts of the loops (Chothia and Lesk, J. Mol. Biol., 1987, 196: 901; Chothia et al., Nature, 1989, 342: 877; Martin and Thornton, J. Mol. Biol, 1996, 263: 800). Furthermore, there is a relationship between the adopted loop structure and the amino acid sequences surrounding it. The conformation of a particular canonical class is determined by the length of the loop and the amino acid residues residing at key positions within the loop, as well as within the conserved framework (i.e., outside of the loop). Assignment to a particular canonical class can therefore be made based on the presence of these key amino acid residues.

The term "canonical structure" may also include considerations as to the linear sequence of the antibody, for example, as catalogued by Kabat (Kabat et al., loc. cit.). The Kabat numbering scheme (system) is a widely adopted standard for numbering the amino acid residues of an antibody variable domain in a consistent manner and is the preferred scheme applied in the present invention as also mentioned elsewhere herein. Additional structural considerations can also be used to determine the canonical structure of an antibody. For example, those differences not fully reflected by Kabat numbering can be described by the numbering system of Chothia et al. and/or revealed by other techniques, for example, crystallography and two- or three-dimensional computational modeling. Accordingly, a given antibody sequence may be placed into a canonical class which allows for, among other things, identifying appropriate chassis sequences (e.g., based on a desire to include a variety of canonical structures in a library). Kabat numbering of antibody amino acid sequences and structural considerations as described by Chothia et al., loc. cit. and their implications for construing canonical aspects of antibody structure, are described in the literature. The subunit structures and three-dimensional configurations of different classes of immunoglobulins are well known in the art. For a review of the antibody structure, see Antibodies: A Laboratory Manual, Cold Spring Harbor Laboratory, eds. Harlow et al., 1988.

The CDR3 of the light chain and, particularly, the CDR3 of the heavy chain may constitute the most important determinants in antigen binding within the light and heavy chain variable regions. In some antibody constructs, the heavy chain CDR3 appears to constitute the major area of contact between the antigen and the antibody. In vitro selection schemes in which CDR3 alone is varied can be used to vary the binding properties of an antibody or determine which residues contribute to the binding of an antigen. Hence, CDR3 is typically the greatest source of molecular diversity within the antibody-binding site. H3, for example, can be as short as two amino acid residues or greater than 26 amino acids.

In a classical full-length antibody or immunoglobulin, each light (L) chain is linked to a heavy (H) chain by one covalent disulfide bond, while the two H chains are linked to each other by one or more disulfide bonds depending on the H chain isotype. The CH domain most proximal to VH is usually designated as CH1. The constant ("C") domains are not directly involved in antigen binding, but exhibit various effector functions, such as antibody-dependent, cell-mediated cytotoxicity and complement activation. The Fc region of an antibody is comprised within the heavy chain constant domains and is for example able to interact with cell surface located Fc receptors.

The sequence of antibody genes after assembly and somatic mutation is highly varied, and these varied genes are estimated to encode $10^{10}$ different antibody molecules (Immunoglobulin Genes, 2nd ed., eds. Jonio et al., Academic Press, San Diego, Calif., 1995). Accordingly, the immune system provides a repertoire of immunoglobulins. The term "repertoire" refers to at least one nucleotide sequence derived wholly or partially from at least one sequence encoding at least one immunoglobulin. The sequence(s) may be generated by rearrangement in vivo of the V, D, and J segments of heavy chains, and the V and J segments of light chains. Alternatively, the sequence(s) can be generated from a cell in response to which rearrangement occurs, e.g., in vitro stimulation. Alternatively, part or all of the sequence(s) may be obtained by DNA splicing, nucleotide synthesis, mutagenesis, and other methods, see, e.g., U.S. Pat. No. 5,565,332. A repertoire may include only one sequence or may include a plurality of sequences, including ones in a genetically diverse collection.

A preferred antibody construct according to the invention can also be defined as a bispecific antibody construct comprising a first (preferably human) binding domain which binds to human DLL3 on the surface of a target cell and a second binding domain which binds to human CD3 on the surface of a T cell, wherein the first binding domain binds to the same epitope of DLL3 as an antibody selected from the group consisting of DLL3-4, DLL3-5, DLL3-6, DLL3-7, DLL3-8, DLL3-9, and DLL3-10, i.e., an antibody comprising a VH region comprising CDR-H1, CDR-H2 and CDR-H3 and a VL region comprising CDR-L1, CDR-L2 and CDR-L3 selected from the group consisting of:

a) CDR-H1 as depicted in SEQ ID NO: 31, CDR-H2 as depicted in SEQ ID NO: 32, CDR-H3 as depicted in SEQ ID NO: 33, CDR-L1 as depicted in SEQ ID NO: 34, CDR-L2 as depicted in SEQ ID NO: 35 and CDR-L3 as depicted in SEQ ID NO: 36;

b) CDR-H1 as depicted in SEQ ID NO: 41, CDR-H2 as depicted in SEQ ID NO: 42, CDR-H3 as depicted in SEQ ID NO: 43, CDR-L1 as depicted in SEQ ID NO: 44, CDR-L2 as depicted in SEQ ID NO: 45 and CDR-L3 as depicted in SEQ ID NO: 46;

c) CDR-H1 as depicted in SEQ ID NO: 51, CDR-H2 as depicted in SEQ ID NO: 52, CDR-H3 as depicted in SEQ ID NO: 53, CDR-L1 as depicted in SEQ ID NO: 54, CDR-L2 as depicted in SEQ ID NO: 55 and CDR-L3 as depicted in SEQ ID NO: 56;

d) CDR-H1 as depicted in SEQ ID NO: 61, CDR-H2 as depicted in SEQ ID NO: 62, CDR-H3 as depicted in SEQ ID NO: 63, CDR-L1 as depicted in SEQ ID NO: 64, CDR-L2 as depicted in SEQ ID NO: 65 and CDR-L3 as depicted in SEQ ID NO: 66;

e) CDR-H1 as depicted in SEQ ID NO: 71, CDR-H2 as depicted in SEQ ID NO: 72, CDR-H3 as depicted in SEQ ID NO: 73, CDR-L1 as depicted in SEQ ID NO: 74, CDR-L2 as depicted in SEQ ID NO: 75 and CDR-L3 as depicted in SEQ ID NO: 76;

f) CDR-H1 as depicted in SEQ ID NO: 81, CDR-H2 as depicted in SEQ ID NO: 82, CDR-H3 as depicted in SEQ ID NO: 83, CDR-L1 as depicted in SEQ ID NO: 84, CDR-L2 as depicted in SEQ ID NO: 85 and CDR-L3 as depicted in SEQ ID NO: 86; and g) CDR-H1 as depicted in SEQ ID NO: 91, CDR-H2 as depicted in SEQ ID NO: 92, CDR-H3 as depicted in SEQ ID NO: 93, CDR-L1 as depicted in SEQ ID NO: 94, CDR-L2 as depicted in SEQ ID NO: 95 and CDR-L3 as depicted in SEQ ID NO: 96.

Whether or not an antibody construct binds to the same epitope of DLL3 as another given antibody construct can be measured e.g. by epitope mapping with chimeric or truncated target molecules, e.g. as described herein above and in Example 2.

A preferred antibody construct according to the invention can also be defined as a bispecific antibody construct comprising a first (preferably human) binding domain which binds to human DLL3 on the surface of a target cell and a second binding domain which binds to human CD3 on the surface of a T cell, wherein the first binding domain competes for binding with an antibody selected from the group consisting of DLL3-4, DLL3-5, DLL3-6, DLL3-7, DLL3-8, DLL3-9, and DLL3-10, i.e., an antibody comprising a VH region comprising CDR-H1, CDR-H2 and CDR-H3 and a VL region comprising CDR-L1, CDR-L2 and CDR-L3 selected from the group consisting of those described above.

Whether or not an antibody construct competes for binding with another given antibody construct can be measured in a competition assay such as a competitive ELISA or a cell-based competition assay. Avidin-coupled microparticles (beads) can also be used. Similar to an avidin-coated ELISA plate, when reacted with a biotinylated protein, each of these beads can be used as a substrate on which an assay can be performed. Antigen is coated onto a bead and then precoated with the first antibody. The second antibody is added and any additional binding is determined. Read-out occurs via flow cytometry.

In one embodiment of the invention, the first binding domain of the antibody construct of the invention comprises a VH region selected from the group consisting of those depicted in SEQ ID NO: 37, SEQ ID NO: 47, SEQ ID NO: 57, SEQ ID NO: 67, SEQ ID NO: 77, SEQ ID NO: 87, SEQ ID NO: 97, SEQ ID NO: 107, SEQ ID NO: 117, SEQ ID NO: 435 and SEQ ID NO: 529.

In a further embodiment, the first binding domain of the antibody construct of the invention comprises a VL region selected from the group consisting of those depicted in SEQ ID NO: 38, SEQ ID NO: 48, SEQ ID NO: 58, SEQ ID NO: 68, SEQ ID NO: 78, SEQ ID NO: 88, SEQ ID NO: 98, SEQ ID NO: 108, SEQ ID NO: 118, SEQ ID NO: 436 and SEQ ID NO: 530.

In another embodiment, the first binding domain of the antibody construct of the invention comprises a VH region and a VL region selected from the group consisting of pairs of a VH region and a VL region as depicted in SEQ ID NOs: 37+38; SEQ ID NOs: 47+48; SEQ ID NOs: 57+58; SEQ ID NOs: 67+68; SEQ ID NOs: 77+78; SEQ ID NOs: 87+88; SEQ ID NOs: 97+98; SEQ ID NOs: 107+108; SEQ ID NOs: 117+118; SEQ ID NOs: 435+436; and SEQ ID Nos: 529+530.

In yet a further embodiment, the first binding domain of the antibody construct of the invention comprises a polypeptide selected from the group consisting of those depicted in SEQ ID NO: 39, SEQ ID NO: 49, SEQ ID NO: 59, SEQ ID NO: 69, SEQ ID NO: 79, SEQ ID NO: 89, SEQ ID NO: 99, SEQ ID NO: 109, SEQ ID NO: 119, SEQ ID NO: 437 and SEQ ID NO: 531.

The above first binding domains (which are specified by their CDRs, VH region and VL region and combinations thereof) characterize as binding domains which bind to a DLL3 epitope comprised within the region as depicted in SEQ ID NO: 258.

The term "bispecific" as used herein refers to an antibody construct which is "at least bispecific", i.e., it comprises at least a first binding domain and a second binding domain, wherein the first binding domain binds to one antigen or target (here: DLL3), and the second binding domain binds to another antigen or target (here: CD3). Accordingly, antibody constructs according to the invention comprise specificities for at least two different antigens or targets. The term "bispecific antibody construct" of the invention also encompasses multispecific antibody constructs such as trispecific antibody constructs, the latter ones including three binding domains, or constructs having more than three (e.g. four, five . . . ) specificites.

Given that the antibody constructs according to the invention are (at least) bispecific, they do not occur naturally and they are markedly different from naturally occurring products. A "bispecific" antibody construct or immunoglobulin is hence an artificial hybrid antibody or immunoglobulin having at least two distinct binding sites with different specificities. Bispecific antibody constructs can be produced by a variety of methods including fusion of hybridomas or linking of Fab' fragments. See, e.g., Songsivilai & Lachmann, Clin. Exp. Immunol. 79:315-321 (1990).

The at least two binding domains and the variable domains of the antibody construct of the present invention may or may not comprise peptide linkers (spacer peptides). The term "peptide linker" comprises in accordance with the present invention an amino acid sequence by which the amino acid sequences of one (variable and/or binding) domain and another (variable and/or binding) domain of the antibody construct of the invention are linked with each other. An essential technical feature of such peptide linker is that it does not comprise any polymerization activity. Among the suitable peptide linkers are those described in U.S. Pat. Nos. 4,751,180 and 4,935,233 or WO 88/09344. The peptide linkers can also be used to attach other domains or modules or regions (such as half-life extending domains) to the antibody construct of the invention.

In the event that a linker is used, this linker is preferably of a length and sequence sufficient to ensure that each of the first and second domains can, independently from one another, retain their differential binding specificities. For peptide linkers which connect the at least two binding domains (or two variable domains) in the antibody construct of the invention, those peptide linkers are preferred which comprise only a few number of amino acid residues, e.g. 12 amino acid residues or less. Thus, peptide linkers of 12, 11, 10, 9, 8, 7, 6 or 5 amino acid residues are preferred. An envisaged peptide linker with less than 5 amino acids comprises 4, 3, 2 or one amino acid(s), wherein Gly-rich linkers are preferred. A particularly preferred "single" amino acid in the context of said "peptide linker" is Gly. Accordingly, said peptide linker may consist of the single amino acid Gly. Another preferred embodiment of a peptide linker is characterized by the amino acid sequence Gly-Gly-Gly-Gly-Ser, i.e. Gly4Ser (SEQ ID NO: 286), or polymers thereof, i.e. (Gly4Ser)x, where x is an integer of 1 or greater (e.g. 2 or 3). Preferred linkers are depicted in SEQ ID NOs: 285-293. The characteristics of said peptide linker, which comprise the absence of the promotion of secondary structures, are known in the art and are described e.g. in Dall'Acqua et al. (Biochem. (1998) 37, 9266-9273), Cheadle et al. (Mol Immunol (1992) 29, 21-30) and Raag and Whitlow (FASEB (1995) 9(1), 73-80). Peptide linkers which furthermore do not promote any secondary structures are preferred. The linkage of said domains to each other can be provided, e.g., by genetic engineering, as described in the examples. Methods for preparing fused and operatively linked bispecific single chain constructs and expressing them in mammalian cells or bacteria are well-known in the art (e.g. WO 99/54440 or Sambrook et al., Molecular Cloning: A Laboratory Manual, Cold Spring Harbor Laboratory Press, Cold Spring Harbor, N.Y., 2001).

As described herein above, the invention provides a preferred embodiment wherein the antibody construct is in a format selected from the group consisting of (scFv)2, scFv-single domain mAb, diabodies and oligomers of any of the aforementioned formats. The term "is in a format" does not exclude that the construct can be further modified, e.g. by attachment or fusion to other moieties, as described herein.

According to a particularly preferred embodiment, and as documented in the appended examples, the antibody construct of the invention is a "bispecific single chain antibody construct", more preferably a bispecific "single chain Fv" (scFv). Although the two domains of the Fv fragment, VL and VH, are coded for by separate genes, they can be joined, using recombinant methods, by a synthetic linker—as described hereinbefore—that enables them to be made as a single protein chain in which the VL and VH regions pair to form a monovalent molecule; see e.g., Huston et al. (1988) Proc. Natl. Acad. Sci USA 85:5879-5883). These antibody fragments are obtained using conventional techniques known to those with skill in the art, and the fragments are evaluated for function in the same manner as are whole or full-length antibodies. A single-chain variable fragment (scFv) is hence a fusion protein of the variable region of the heavy chain (VH) and of the light chain (VL) of immunoglobulins, usually connected with a short linker peptide of about ten to about 25 amino acids, preferably about 15 to 20 amino acids. The linker is usually rich in glycine for flexibility, as well as serine or threonine for solubility, and can either connect the N-terminus of the VH with the C-terminus of the VL, or vice versa. This protein retains the specificity of the original immunoglobulin, despite removal of the constant regions and introduction of the linker.

Bispecific single chain molecules are known in the art and are described in WO 99/54440, Mack, J. Immunol. (1997), 158, 3965-3970, Mack, PNAS, (1995), 92, 7021-7025, Kufer, Cancer Immunol. Immunother., (1997), 45, 193-197, Löffler, Blood, (2000), 95, 6, 2098-2103, Brühl, Immunol., (2001), 166, 2420-2426, Kipriyanov, J. Mol. Biol., (1999), 293, 41-56. Techniques described for the production of single chain antibodies (see, inter alia, U.S. Pat. No. 4,946,778, Kontermann and Dübel (2010), loc. cit. and Little (2009), loc. cit.) can be adapted to produce single chain antibody constructs specifically recognizing (an) elected target(s).

Bivalent (also called divalent) or bispecific single-chain variable fragments (bi-scFvs or di-scFvs having the format (scFv)2 can be engineered by linking two scFv molecules (e.g. with linkers as described hereinbefore). If these two scFv molecules have the same binding specificity, the resulting (scFv)2 molecule will preferably be called bivalent (i.e. it has two valences for the same target epitope). If the two scFv molecules have different binding specificities, the resulting (scFv)2 molecule will preferably be called bispecific. The linking can be done by producing a single peptide chain with two VH regions and two VL regions, yielding tandem scFvs (see e.g. Kufer P. et al., (2004) Trends in Biotechnology 22(5):238-244). Another possibility is the creation of scFv molecules with linker peptides that are too short for the two variable regions to fold together (e.g. about five amino acids), forcing the scFvs to dimerize. This type is known as diabodies (see e.g. Hollinger, Philipp et al., (July 1993) Proceedings of the National Academy of Sciences of the United States of America 90 (14): 6444-8.).

According to a further preferred embodiment of the antibody construct of the invention the heavy chain (VH) and the light chain (VL) of a binding domain (binding either to the target antigen DLL3 or to CD3) are not directly connected via a peptide linker as described above, but the binding domains are formed as described for the diabody. Thus, the VH of the CD3 binding domain may be fused to the VL of the DLL3 binding domain via a peptide linker, and the VH of the DLL3 binding domain is fused to the VL of the CD3 binding domain via such peptide linker.

Single domain antibodies comprise merely one (monomeric) antibody variable domain which is able to bind selectively to a specific antigen, independently of other V regions or domains. The first single domain antibodies were engineered from heavy chain antibodies found in camelids, and these are called VHH fragments. Cartilaginous fishes also have heavy chain antibodies (IgNAR) from which single domain antibodies called VNAR fragments can be obtained. An alternative approach is to split the dimeric variable domains from common immunoglobulins e.g. from humans or rodents into monomers, hence obtaining VH or VL as a single domain Ab. Although most research into single domain antibodies is currently based on heavy chain variable domains, nanobodies derived from light chains have also been shown to bind specifically to target epitopes. Examples of single domain antibodies are called sdAb, nanobodies or single variable domain antibodies.

A (single domain mAb)2 is hence a monoclonal antibody construct composed of (at least) two single domain monoclonal antibodies, which are individually selected from the group comprising VH, VL, VHH and VNAR. The linker is preferably in the form of a peptide linker. Similarly, an "scFv-single domain mAb" is a monoclonal antibody construct composed of at least one single domain antibody as described above and one scFv molecule as described above. Again, the linker is preferably in the form of a peptide linker.

It is furthermore envisaged that the present invention provides a bispecific antibody construct comprising a first binding domain which binds to human DLL3 on the surface of a target cell and a second binding domain which binds to human CD3 on the surface of a T cell, wherein the first binding domain binds to an epitope of DLL3 which is comprised within the region as depicted in SEQ ID NO: 259.

Accordingly, in a further aspect of the invention, the first binding domain of the bispecific antibody construct comprises a VH region comprising CDR-H1, CDR-H2 and CDR-H3 and a VL region comprising CDR-L1, CDR-L2 and CDR-L3 selected from the group consisting of:

a) CDR-H1 as depicted in SEQ ID NO: 121, CDR-H2 as depicted in SEQ ID NO: 122, CDR-H3 as depicted in SEQ ID NO: 123, CDR-L1 as depicted in SEQ ID NO: 124, CDR-L2 as depicted in SEQ ID NO: 125 and CDR-L3 as depicted in SEQ ID NO: 126;

b) CDR-H1 as depicted in SEQ ID NO: 131, CDR-H2 as depicted in SEQ ID NO: 132, CDR-H3 as depicted in SEQ ID NO: 133, CDR-L1 as depicted in SEQ ID NO: 134, CDR-L2 as depicted in SEQ ID NO: 135 and CDR-L3 as depicted in SEQ ID NO: 136;

c) CDR-H1 as depicted in SEQ ID NO: 141, CDR-H2 as depicted in SEQ ID NO: 142, CDR-H3 as depicted in SEQ ID NO: 143, CDR-L1 as depicted in SEQ ID NO: 144, CDR-L2 as depicted in SEQ ID NO: 145 and CDR-L3 as depicted in SEQ ID NO: 146;

d) CDR-H1 as depicted in SEQ ID NO: 151, CDR-H2 as depicted in SEQ ID NO: 152, CDR-H3 as depicted in SEQ ID NO: 153, CDR-L1 as depicted in SEQ ID NO: 154, CDR-L2 as depicted in SEQ ID NO: 155 and CDR-L3 as depicted in SEQ ID NO: 156; and e) CDR-H1 as depicted in SEQ ID NO: 161, CDR-H2 as depicted in SEQ ID NO: 162, CDR-H3 as depicted in SEQ ID NO: 163, CDR-L1 as depicted in SEQ ID NO: 164, CDR-L2 as depicted in SEQ ID NO: 165 and CDR-L3 as depicted in SEQ ID NO: 166;

f) CDR-H1 as depicted in SEQ ID NO: 131, CDR-H2 as depicted in SEQ ID NO: 439, CDR-H3 as depicted in SEQ ID NO: 133, CDR-L1 as depicted in SEQ ID NO: 134, CDR-L2 as depicted in SEQ ID NO: 135 and CDR-L3 as depicted in SEQ ID NO: 136;

g) CDR-H1 as depicted in SEQ ID NO: 131, CDR-H2 as depicted in SEQ ID NO: 440, CDR-H3 as depicted in SEQ ID NO: 133, CDR-L1 as depicted in SEQ ID NO: 134, CDR-L2 as depicted in SEQ ID NO: 135 and CDR-L3 as depicted in SEQ ID NO: 136;

h) CDR-H1 as depicted in SEQ ID NO: 131, CDR-H2 as depicted in SEQ ID NO: 132, CDR-H3 as depicted in SEQ ID NO: 133, CDR-L1 as depicted in SEQ ID NO: 441, CDR-L2 as depicted in SEQ ID NO: 135 and CDR-L3 as depicted in SEQ ID NO: 136;

i) CDR-H1 as depicted in SEQ ID NO: 131, CDR-H2 as depicted in SEQ ID NO: 132, CDR-H3 as depicted in SEQ ID NO: 133, CDR-L1 as depicted in SEQ ID NO: 442, CDR-L2 as depicted in SEQ ID NO: 135 and CDR-L3 as depicted in SEQ ID NO: 136;

j) CDR-H1 as depicted in SEQ ID NO: 131, CDR-H2 as depicted in SEQ ID NO: 132, CDR-H3 as depicted in SEQ ID NO: 133, CDR-L1 as depicted in SEQ ID NO: 443, CDR-L2 as depicted in SEQ ID NO: 135 and CDR-L3 as depicted in SEQ ID NO: 136;

k) CDR-H1 as depicted in SEQ ID NO: 131, CDR-H2 as depicted in SEQ ID NO: 132, CDR-H3 as depicted in SEQ ID NO: 133, CDR-L1 as depicted in SEQ ID NO: 444, CDR-L2 as depicted in SEQ ID NO: 135 and CDR-L3 as depicted in SEQ ID NO: 136;

l) CDR-H1 as depicted in SEQ ID NO: 131, CDR-H2 as depicted in SEQ ID NO: 439, CDR-H3 as depicted in SEQ ID NO: 133, CDR-L1 as depicted in SEQ ID NO: 441, CDR-L2 as depicted in SEQ ID NO: 135 and CDR-L3 as depicted in SEQ ID NO: 136; and m) CDR-H1 as depicted in SEQ ID NO: 131, CDR-H2 as depicted in SEQ ID NO: 440, CDR-H3 as depicted in SEQ ID NO: 133, CDR-L1 as depicted in SEQ ID NO: 442, CDR-L2 as depicted in SEQ ID NO: 135 and CDR-L3 as depicted in SEQ ID NO: 136.

In one embodiment, the first binding domain of the antibody construct of the invention comprises a VH region selected from the group consisting of those depicted in SEQ ID NO: 127, SEQ ID NO: 137, SEQ ID NO: 147, SEQ ID NO: 157, SEQ ID NO: 167, SEQ ID NO: 445, SEQ ID NO: 446, SEQ ID NO: 447, SEQ ID NO: 448, SEQ ID NO: 449, SEQ ID NO: 450, SEQ ID NO: 451, SEQ ID NO: 452, SEQ ID NO: 453, SEQ ID NO: 454, and SEQ ID NO: 455.

In a further embodiment, the first binding domain of the antibody construct of the invention comprises a VL region selected from the group consisting of those depicted in SEQ ID NO: 128, SEQ ID NO: 138, SEQ ID NO: 148, SEQ ID NO: 158, SEQ ID NO: 168, SEQ ID NO: 456, SEQ ID NO: 457, SEQ ID NO: 458, SEQ ID NO: 459, SEQ ID NO: 460, SEQ ID NO: 461, SEQ ID NO: 462, SEQ ID NO: 463, SEQ ID NO: 464, SEQ ID NO: 465, SEQ ID NO: 466, SEQ ID NO: 467, SEQ ID NO: 468, SEQ ID NO: 469, and SEQ ID NO: 470.

In another embodiment, the first binding domain of the antibody construct of the invention comprises a VH region and a VL region selected from the group consisting of pairs of a VH region and a VL region as depicted in SEQ ID NOs: 127+128; SEQ ID NOs: 137+138; SEQ ID NOs: 147+148; SEQ ID NOs: 157+158; SEQ ID NOs: 167+168; SEQ ID NOs 137+456; SEQ ID NOs 137+457; SEQ ID NOs 137+458; SEQ ID NOs 137+459; SEQ ID NOs 137+460; SEQ ID NOs 445+138; SEQ ID NOs 446+138; SEQ ID NOs 447+138; SEQ ID NOs 445+460; SEQ ID NOs 448+461; SEQ ID NOs 449+462; SEQ ID NOs 450+463; SEQ ID NOs 450+464; SEQ ID NOs 450+465; SEQ ID NOs 450+466; SEQ ID NOs 450+467; SEQ ID NOs 450+468; SEQ ID NOs 451+463; SEQ ID NOs 452+463; SEQ ID NOs 453+463; SEQ ID NOs 451+468; SEQ ID NOs 454+469; and SEQ ID NOs 455+470.

In a further embodiment, the first binding domain of the antibody construct of the invention comprises a polypeptide selected from the group consisting of those depicted in SEQ ID NO: 129, SEQ ID NO: 139, SEQ ID NO: 149, SEQ ID NO: 159, SEQ ID NO: 169, SEQ ID NO: 471, SEQ ID NO: 472, SEQ ID NO: 473, SEQ ID NO: 474, SEQ ID NO: 475, SEQ ID NO: 476, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 485, SEQ ID NO: 486, SEQ ID NO: 487, SEQ ID NO: 488, SEQ ID NO: 489, SEQ ID NO: 490, SEQ ID NO: 491, SEQ ID NO: 492, and SEQ ID NO: 493.

The above first binding domains (which are specified by their CDRs, VH region and VL region and combinations thereof) characterize as binding domains which bind to a DLL3 epitope comprised within the region as depicted in SEQ ID NO: 259.

Another preferred antibody construct according to the invention can also be defined as a bispecific antibody construct comprising a first (preferably human) binding domain which binds to human DLL3 on the surface of a target cell and a second binding domain which binds to human CD3 on the surface of a T cell, wherein the first binding domain binds to the same epitope of DLL3 as an antibody selected from the group consisting of DLL3-13, DLL3-14, and DLL3-15, i.e., an antibody comprising a VH region comprising CDR-H1, CDR-H2 and CDR-H3 and a VL region comprising CDR-L1, CDR-L2 and CDR-L3 selected from the group consisting of:

a) CDR-H1 as depicted in SEQ ID NO: 121, CDR-H2 as depicted in SEQ ID NO: 122, CDR-H3 as depicted in SEQ ID NO: 123, CDR-L1 as depicted in SEQ ID NO: 124, CDR-L2 as depicted in SEQ ID NO: 125 and CDR-L3 as depicted in SEQ ID NO: 126;

b) CDR-H1 as depicted in SEQ ID NO: 131, CDR-H2 as depicted in SEQ ID NO: 132, CDR-H3 as depicted in SEQ ID NO: 133, CDR-L1 as depicted in SEQ ID NO: 134, CDR-L2 as depicted in SEQ ID NO: 135 and CDR-L3 as depicted in SEQ ID NO: 136; and c) CDR-H1 as depicted in SEQ ID NO: 141, CDR-H2 as depicted in SEQ ID NO: 142, CDR-H3 as depicted in SEQ ID NO: 143, CDR-L1 as depicted in SEQ ID NO: 144, CDR-L2 as depicted in SEQ ID NO: 145 and CDR-L3 as depicted in SEQ ID NO: 146.

Another preferred antibody construct according to the invention can also be defined as a bispecific antibody construct comprising a first (preferably human) binding domain which binds to human DLL3 on the surface of a target cell and a second binding domain which binds to human CD3 on the surface of a T cell, wherein the first binding domain competes for binding with an antibody selected from the group consisting of DLL3-13, DLL3-14, and DLL3-15, i.e., an antibody comprising a VH region comprising CDR-H1, CDR-H2 and CDR-H3 and a VL region comprising CDR-L1, CDR-L2 and CDR-L3 selected from the group consisting of those described above.

It is also envisaged that the antibody construct of the invention has, in addition to its function to bind to the target molecules DLL3 and CD3, a further function. In this format, the antibody construct is a trifunctional or multifunctional antibody construct by targeting target cells through binding to DLL3, mediating cytotoxic T cell activity through CD3 binding and providing a further function such as a fully functional Fc constant domain mediating antibody-dependent cellular cytotoxicity through recruitment of effector cells like NK cells, a label (fluorescent etc.), a therapeutic agent such as a toxin or radionuclide, and/or means to enhance serum half-life, etc.

Examples for means to extend serum half-life of the antibody constructs of the invention include peptides, proteins or domains of proteins, which are fused or otherwise attached to the antibody constructs. The group of peptides, proteins or protein domains includes peptides binding to other proteins with preferred pharmacokinetic profile in the human body such as serum albumin (see WO 2009/127691). An alternative concept of such half-life extending peptides includes peptides binding to the neonatal Fc receptor (FcRn, see WO 2007/098420), which can also be used in the constructs of the present invention. The concept of attaching larger domains of proteins or complete proteins includes e.g. the fusion of human serum albumin, variants or mutants of human serum albumin (see WO 2011/051489, WO 2012/059486, WO 2012/150319, WO 2013/135896, WO 2014/072481, WO 2013/075066) or domains thereof as well as the fusion of constant region of immunoglobulins (Fc domains) and variants thereof. Such variants of Fc domains may be optimized/modified in order to allow the desired pairing of dimers or mulimers, to abolish Fc receptor binding (e.g. the Fcγ receptor) or for other reasons. A further concept known in the art to extend the half-life of small protein compounds in the human body is the pegylation of those compounds such as the antibody construct of the present invention.

In a preferred embodiment, the bispecific antibody constructs according to the invention may be linked (e.g. via peptide bond) with a fusion partner (such as a protein or polypeptide or peptide), e.g. for the purpose of extending the construct's serum half-life. These fusion partners can be selected from human serum albumin ("HSA" or "HALB") as wells as sequence variants thereof, peptides binding to HSA, peptides binding to FcRn ("FcRn BP"), or constructs comprising an (antibody derived) Fc region. Exemplary sequences of these fusion partners are depicted in SEQ ID NOs: 295-341. In general, the fusion partners may be linked to the N-terminus or to the C-terminus of the bispecific antibody constructs according to the invention, either directly (e.g. via peptide bond) or through a peptide linker such as (GGGGS)n (wherein "n" is an integer of 2 or greater, e.g. 2 or 3 or 4). Suitable peptide linkers are depicted in SEQ ID NOs: 285-293.

Hence, a preferred antibody construct according to the present invention comprises:

(a) a polypeptide comprising in the following order starting from the N-terminus:

a polypeptide having an amino acid sequence selected from the group consisting of SEQ ID NO: 39, SEQ ID NO: 49, SEQ ID NO: 59, SEQ ID NO: 69, SEQ ID NO: 79, SEQ ID NO: 89, SEQ ID NO: 99, SEQ ID NO: 109, SEQ ID NO: 119, SEQ ID NO: 129, SEQ ID NO: 139, SEQ ID NO: 149, SEQ ID NO: 159, SEQ ID NO: 169, SEQ ID NO: 437, SEQ ID NO: 471, SEQ ID NO: 472, SEQ ID NO: 473, SEQ ID NO: 474, SEQ ID NO: 475, SEQ ID NO: 476, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 485, SEQ ID NO: 486, SEQ ID NO: 487, SEQ ID NO: 488, SEQ ID NO: 489, SEQ ID NO: 490, SEQ ID NO: 491, SEQ ID NO: 492, SEQ ID NO: 493, and SEQ ID NO: 531;

a peptide linker having an amino acid sequence selected from the group consisting of SEQ ID NOs: 285-293; and a polypeptide having an amino acid sequence selected from the group consisting of SEQ ID NO: 350, SEQ ID NO: 359, SEQ ID NO: 368, SEQ ID NO: 377, SEQ ID NO: 386, SEQ ID NO: 395, SEQ ID NO: 404, SEQ ID NO: 413, SEQ ID NO: 422, SEQ ID NO: 431, and SEQ ID NO: 434; and optionally a His-tag, such as the one depicted in SEQ ID NO: 294;

(b) a polypeptide comprising in the following order starting from the N-terminus:

a polypeptide having an amino acid sequence selected from the group consisting of SEQ ID NO: 39, SEQ ID NO: 49, SEQ ID NO: 59, SEQ ID NO: 69, SEQ ID NO: 79, SEQ ID NO: 89, SEQ ID NO: 99, SEQ ID NO: 109, SEQ ID NO: 119, SEQ ID NO: 129, SEQ ID NO: 139, SEQ ID NO: 149, SEQ ID NO: 159, SEQ ID NO: 169, SEQ ID NO: 437, SEQ ID NO: 471, SEQ ID NO: 472, SEQ ID NO: 473, SEQ ID NO: 474, SEQ ID NO: 475, SEQ ID NO: 476, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 485, SEQ ID NO: 486, SEQ ID NO: 487, SEQ ID NO: 488, SEQ ID NO: 489, SEQ ID NO: 490, SEQ ID NO: 491, SEQ ID NO: 492, SEQ ID NO: 493, and SEQ ID NO: 531;

a peptide linker having an amino acid sequence selected from the group consisting of SEQ ID NOs: 285-293;

a polypeptide having an amino acid sequence selected from the group consisting of SEQ ID NO: 350, SEQ ID NO: 359, SEQ ID NO: 368, SEQ ID NO: 377, SEQ ID NO: 386, SEQ ID NO: 395, SEQ ID NO: 404, SEQ ID NO: 413, SEQ ID NO: 422, SEQ ID NO: 431, and SEQ ID NO: 434;

optionally a peptide linker having an amino acid sequence selected from the group consisting of SEQ ID NOs: 285-293;

a polypeptide having an amino acid sequence selected from the group consisting of SEQ ID NOs: 295 and 301-330; and optionally a His-tag, such as the one depicted in SEQ ID NO: 294;

(c) a polypeptide comprising in the following order starting from the N-terminus:

a polypeptide having the amino acid sequence QRFVTGHFGGLX1PANG (SEQ ID NO: 296) wherein X1 is Y or H; and a polypeptide having an amino acid sequence selected from the group consisting of SEQ ID NO: 39, SEQ ID NO: 49, SEQ ID NO: 59, SEQ ID NO: 69, SEQ ID NO: 79, SEQ ID NO: 89, SEQ ID NO: 99, SEQ ID NO: 109, SEQ ID NO: 119, SEQ ID NO: 129, SEQ ID NO: 139, SEQ ID NO: 149, SEQ ID NO: 159, SEQ ID NO: 169, SEQ ID NO: 437, SEQ ID NO: 471, SEQ ID NO: 472, SEQ ID NO: 473, SEQ ID NO: 474, SEQ ID NO: 475, SEQ ID NO: 476, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 485, SEQ ID NO: 486, SEQ ID NO: 487, SEQ ID NO: 488, SEQ ID NO: 489, SEQ ID NO: 490, SEQ ID NO: 491, SEQ ID NO: 492, SEQ ID NO: 493, and SEQ ID NO: 531;

a peptide linker having an amino acid sequence selected from the group consisting of SEQ ID NOs: 285-293;

a polypeptide having an amino acid sequence selected from the group consisting of SEQ ID NO: 350, SEQ ID NO: 359, SEQ ID NO: 368, SEQ ID NO: 377, SEQ ID NO: 386, SEQ ID NO: 395, SEQ ID NO: 404, SEQ ID NO: 413, SEQ ID NO: 422, SEQ ID NO: 431, and SEQ ID NO: 434;

a polypeptide having the amino acid sequence QRFVTGHFGGLHPANG (SEQ ID NO: 298) or QRFCTGHFGGLHPCNG (SEQ ID NO: 300); and optionally a His-tag, such as the one depicted in SEQ ID NO: 294;

(d) a polypeptide comprising in the following order starting from the N-terminus a polypeptide having an amino acid sequence selected from the group consisting of SEQ ID NO: 348, SEQ ID NO: 357, SEQ ID NO: 366, SEQ ID NO: 375, SEQ ID NO: 384, SEQ ID NO: 393, SEQ ID NO: 402, SEQ ID NO: 411, SEQ ID NO: 420, SEQ ID NO: 429, and SEQ ID NO: 432;

a peptide linker having the amino acid sequence depicted in SEQ ID NO: 292;

a polypeptide having an amino acid sequence selected from the group consisting of SEQ ID NO: 38, SEQ ID NO: 48, SEQ ID NO: 58, SEQ ID NO: 68, SEQ ID NO: 78, SEQ ID NO: 88, SEQ ID NO: 98, SEQ ID NO: 108, SEQ ID NO: 118, SEQ ID NO: 128, SEQ ID NO: 138, SEQ ID NO: 148, SEQ ID NO: 158, SEQ ID NO: 168, SEQ ID NO: 436, SEQ ID NO: 456, SEQ ID NO: 457, SEQ ID NO: 458, SEQ ID NO: 459, SEQ ID NO: 460, SEQ ID NO: 461, SEQ ID NO: 462, SEQ ID NO: 463, SEQ ID NO: 464, SEQ ID NO: 465, SEQ ID NO: 466, SEQ ID NO: 467, SEQ ID NO: 468, SEQ ID NO: 469, SEQ ID NO: 470, and SEQ ID NO: 530, followed by a serine residue at the C-terminus;

a polypeptide having the amino acid sequence depicted in SEQ ID NO: 331; and a polypeptide comprising in the following order starting from the N-terminus:

a polypeptide having an amino acid sequence selected from the group consisting of SEQ ID NO: 37, SEQ ID NO: 47, SEQ ID NO: 57, SEQ ID NO: 67, SEQ ID NO: 77, SEQ ID NO: 87, SEQ ID NO: 97, SEQ ID NO: 107, SEQ ID NO: 117, SEQ ID NO: 127, SEQ ID NO: 137, SEQ ID NO: 147, SEQ ID NO: 157, SEQ ID NO: 167, SEQ ID NO: 435, SEQ ID NO: 445, SEQ ID NO: 446, SEQ ID NO: 447, SEQ ID NO: 448, SEQ ID NO: 449, SEQ ID NO: 450, SEQ ID NO: 451, SEQ ID NO: 452, SEQ ID NO: 453, SEQ ID NO: 454, and SEQ ID NO: 455, and SEQ ID NO: 529;

a peptide linker having the amino acid sequence depicted in SEQ ID NO: 292;

a polypeptide having an amino acid sequence selected from the group consisting of SEQ ID NO: 349, SEQ ID NO: 358, SEQ ID NO: 367, SEQ ID NO: 376, SEQ ID NO: 385, SEQ ID NO: 394, SEQ ID NO: 403, SEQ ID NO: 412, SEQ ID NO: 421, SEQ ID NO: 430, and SEQ ID NO: 433 followed by a serine residue at the C-terminus; and a polypeptide having the amino acid sequence depicted in SEQ ID NO: 332;

(e) a polypeptide comprising in the following order starting from the N-terminus:

a polypeptide having an amino acid sequence selected from the group consisting of SEQ ID NO: 348, SEQ ID NO: 357, SEQ ID NO: 366, SEQ ID NO: 375, SEQ ID NO: 384, SEQ ID NO: 393, SEQ ID NO: 402, SEQ ID NO: 411, SEQ ID NO: 420, SEQ ID NO: 429, and SEQ ID NO: 432;

a peptide linker having the amino acid sequence depicted in SEQ ID NO: 292;

a polypeptide having an amino acid sequence selected from the group consisting of SEQ ID NO: 38, SEQ ID NO: 48, SEQ ID NO: 58, SEQ ID NO: 68, SEQ ID NO: 78, SEQ ID NO: 88, SEQ ID NO: 98, SEQ ID NO: 108, SEQ ID NO: 118, SEQ ID NO: 128, SEQ ID NO: 138, SEQ ID NO: 148, SEQ ID NO: 158, SEQ ID NO: 168, SEQ ID NO: 436, SEQ ID NO: 456, SEQ ID NO: 457, SEQ ID NO: 458, SEQ ID NO: 459, SEQ ID NO: 460, SEQ ID NO: 461, SEQ ID NO: 462, SEQ ID NO: 463, SEQ ID NO: 464, SEQ ID NO: 465, SEQ ID NO: 466, SEQ ID NO: 467, SEQ ID NO: 468, SEQ ID NO: 469, SEQ ID NO: 470, and SEQ ID NO: 530; and a polypeptide having the amino acid sequence depicted in SEQ ID NO: 333; and a polypeptide comprising in the following order starting from the N-terminus:

a polypeptide having an amino acid sequence selected from the group consisting of SEQ ID NO: 37, SEQ ID NO: 47, SEQ ID NO: 57, SEQ ID NO: 67, SEQ ID NO: 77, SEQ ID NO: 87, SEQ ID NO: 97, SEQ ID NO: 107, SEQ ID NO: 117, SEQ ID NO: 127, SEQ ID NO: 137, SEQ ID NO: 147, SEQ ID NO: 157, and SEQ ID NO: 167, SEQ ID NO: 435, SEQ ID NO: 445, SEQ ID NO: 446, SEQ ID NO: 447, SEQ ID NO: 448, SEQ ID NO: 449, SEQ ID NO: 450, SEQ ID NO: 451, SEQ ID NO: 452, SEQ ID NO: 453, SEQ ID NO: 454, SEQ ID NO: 455, and SEQ ID NO: 529;

a peptide linker having the amino acid sequence depicted in SEQ ID NO: 292;
a polypeptide having an amino acid sequence selected from the group consisting of SEQ ID NO: 349, SEQ ID NO: 358, SEQ ID NO: 367, SEQ ID NO: 376, SEQ ID NO: 385, SEQ ID NO: 394, SEQ ID NO: 403, SEQ ID NO: 412, SEQ ID NO: 421, SEQ ID NO: 430, and SEQ ID NO: 433 followed by a serine residue at the C-terminus; and
a polypeptide having the amino acid sequence depicted in SEQ ID NO: 334;

(f) a polypeptide comprising in the following order starting from the N-terminus:
a polypeptide having an amino acid sequence selected from the group consisting of SEQ ID NO: 39, SEQ ID NO: 49, SEQ ID NO: 59, SEQ ID NO: 69, SEQ ID NO: 79, SEQ ID NO: 89, SEQ ID NO: 99, SEQ ID NO: 109, SEQ ID NO: 119, SEQ ID NO: 129, SEQ ID NO: 139, SEQ ID NO: 149, SEQ ID NO: 159, SEQ ID NO: 169, SEQ ID NO: 437, SEQ ID NO: 471, SEQ ID NO: 472, SEQ ID NO: 473, SEQ ID NO: 474, SEQ ID NO: 475, SEQ ID NO: 476, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 485, SEQ ID NO: 486, SEQ ID NO: 487, SEQ ID NO: 488, SEQ ID NO: 489, SEQ ID NO: 490, SEQ ID NO: 491, SEQ ID NO: 492, SEQ ID NO: 493, and SEQ ID NO: 531;
a peptide linker having an amino acid sequence selected from the group consisting of SEQ ID NOs: 285-293;
a polypeptide having an amino acid sequence selected from the group consisting of SEQ ID NO: 350, SEQ ID NO: 359, SEQ ID NO: 368, SEQ ID NO: 377, SEQ ID NO: 386, SEQ ID NO: 395, SEQ ID NO: 404, SEQ ID NO: 413, SEQ ID NO: 422, SEQ ID NO: 431, and SEQ ID NO: 434;
a polypeptide having the amino acid sequence depicted in SEQ ID NO: 335; and
a polypeptide having the amino acid sequence depicted in SEQ ID NO: 336;

(g) a polypeptide comprising in the following order starting from the N-terminus:
a polypeptide having an amino acid sequence selected from the group consisting of SEQ ID NO: 39, SEQ ID NO: 49, SEQ ID NO: 59, SEQ ID NO: 69, SEQ ID NO: 79, SEQ ID NO: 89, SEQ ID NO: 99, SEQ ID NO: 109, SEQ ID NO: 119, SEQ ID NO: 129, SEQ ID NO: 139, SEQ ID NO: 149, SEQ ID NO: 159, SEQ ID NO: 169, SEQ ID NO: 437, SEQ ID NO: 471, SEQ ID NO: 472, SEQ ID NO: 473, SEQ ID NO: 474, SEQ ID NO: 475, SEQ ID NO: 476, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 485, SEQ ID NO: 486, SEQ ID NO: 487, SEQ ID NO: 488, SEQ ID NO: 489, SEQ ID NO: 490, SEQ ID NO: 491, SEQ ID NO: 492, SEQ ID NO: 493, and SEQ ID NO: 531; and
a polypeptide having the amino acid sequence depicted in SEQ ID NO: 337; and
a polypeptide comprising in the following order starting from the N-terminus:
a polypeptide having an amino acid sequence selected from the group consisting of SEQ ID NO: 350, SEQ ID NO: 359, SEQ ID NO: 368, SEQ ID NO: 377, SEQ ID NO: 386, SEQ ID NO: 395, SEQ ID NO: 404, SEQ ID NO: 413, SEQ ID NO: 422, SEQ ID NO: 431, and SEQ ID NO: 434; and
a polypeptide having the amino acid sequence depicted in SEQ ID NO: 338;

(h) a polypeptide comprising in the following order starting from the N-terminus:
a polypeptide having an amino acid sequence selected from the group consisting of SEQ ID NO: 39, SEQ ID NO: 49, SEQ ID NO: 59, SEQ ID NO: 69, SEQ ID NO: 79, SEQ ID NO: 89, SEQ ID NO: 99, SEQ ID NO: 109, SEQ ID NO: 119, SEQ ID NO: 129, SEQ ID NO: 139, SEQ ID NO: 149, SEQ ID NO: 159, SEQ ID NO: 169, SEQ ID NO: 437, SEQ ID NO: 471, SEQ ID NO: 472, SEQ ID NO: 473, SEQ ID NO: 474, SEQ ID NO: 475, SEQ ID NO: 476, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 485, SEQ ID NO: 486, SEQ ID NO: 487, SEQ ID NO: 488, SEQ ID NO: 489, SEQ ID NO: 490, SEQ ID NO: 491, SEQ ID NO: 492, SEQ ID NO: 493, and SEQ ID NO: 531; and
a polypeptide having the amino acid sequence depicted in SEQ ID NO: 339; and
a polypeptide comprising in the following order starting from the N-terminus:
a polypeptide having an amino acid sequence selected from the group consisting of SEQ ID NO: 350, SEQ ID NO: 359, SEQ ID NO: 368, SEQ ID NO: 377, SEQ ID NO: 386, SEQ ID NO: 395, SEQ ID NO: 404, SEQ ID NO: 413, SEQ ID NO: 422, SEQ ID NO: 431, and SEQ ID NO: 434; and
a polypeptide having the amino acid sequence depicted in SEQ ID NO: 340; or (i) a polypeptide comprising in the following order starting from the N-terminus:
a polypeptide having an amino acid sequence selected from the group consisting of SEQ ID NO: 39, SEQ ID NO: 49, SEQ ID NO: 59, SEQ ID NO: 69, SEQ ID NO: 79, SEQ ID NO: 89, SEQ ID NO: 99, SEQ ID NO: 109, SEQ ID NO: 119, SEQ ID NO: 129, SEQ ID NO: 139, SEQ ID NO: 149, SEQ ID NO: 159, SEQ ID NO: 169, SEQ ID NO: 437, SEQ ID NO: 471, SEQ ID NO: 472, SEQ ID NO: 473, SEQ ID NO: 474, SEQ ID NO: 475, SEQ ID NO: 476, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 485, SEQ ID NO: 486, SEQ ID NO: 487, SEQ ID NO: 488, SEQ ID NO: 489, SEQ ID NO: 490, SEQ ID NO: 491, SEQ ID NO: 492, SEQ ID NO: 493, and SEQ ID NO: 531;
a peptide linker having an amino acid sequence selected from the group consisting of SEQ ID NOs: 285-293;
a polypeptide having an amino acid sequence selected from the group consisting of SEQ ID NO: 350, SEQ ID NO: 359, SEQ ID NO: 368, SEQ ID NO: 377, SEQ ID NO: 386, SEQ ID NO: 395, SEQ ID NO: 404, SEQ ID NO: 413, SEQ ID NO: 422, SEQ ID NO: 431, and SEQ ID NO: 434; and
a polypeptide having the amino acid sequence depicted in SEQ ID NO: 341.

For example, a preferred bispecific antibody construct of the present invention comprises or consists of a polypeptide selected from the group consisting of those depicted in: SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237; SEQ ID NO: 242, SEQ ID NO: 243, SEQ ID NO: 244, SEQ ID NO: 245, SEQ ID NO: 246, SEQ ID NO: 247, SEQ ID NO: 248, SEQ ID NO: 249, SEQ ID NO: 250, and SEQ ID NO: 251.

As described above, several preferred antibody constructs of the invention are modified by fusion with another moiety such as albumin or albumin variants. If these fusion constructs are characterized for their properties, such as in particular their target affinity or cytotoxic activity, the skilled person will be aware that similar fusion constructs or unmodified bispecific antibody constructs can be expected to have similar (or possibly even better) properties. For example, if a bispecific antibody construct fused with albumin has an appreciable or desirable cytotoxic activity or target affinity, it can be expected that the same/similar or even a higher cytotoxic activity/target affinity will be observed for the same construct w/o albumin.

According to another preferred embodiment, the bispecific antibody construct of the invention comprises (in addition to the two binding domains) a third domain which comprises two polypeptide monomers, each comprising a hinge, a CH2 and a CH3 domain, wherein said two polypeptides (or polypeptide monomers) are fused to each other via a peptide linker. Preferably, said third domain comprises in an N- to C-terminal order: hinge-CH2-CH3-linker-hinge-CH2-CH3. Preferred amino acid sequences for said third domain are depicted in SEQ ID NOs: 541-548. Each of said polypeptide monomers preferably has an amino acid sequence that is selected from the group consisting of SEQ ID NOs: 533-540, or that is at least 90% identical to those sequences. In another preferred embodiment, the first and second binding domains of the bispecific antibody construct of the invention are fused to the third domain via a peptide linker which is for example selected from the group consisting of SEQ ID NOs: 285, 286, 288, 289, 290, 292 and 293.

In line with the present invention, a "hinge" is an IgG hinge region. This region can be identified by analogy using the Kabat numbering, see Kabat positions 223-243. In line with the above, the minimal requirement for a "hinge" are the amino acid residues corresponding to the IgG1 sequence stretch of D231 to P243 according to the Kabat numbering. The terms CH2 and CH3 refer to the immunoglobulin heavy chain constant regions 2 and 3. These regions can as well be identified by analogy using the Kabat numbering, see Kabat positions 244-360 for CH2 and Kabat positions 361-478 for CH3. Is is understood that there is some variation between the immunoglobulins in terms of their IgG1 Fc region, IgG2 Fc region, IgG3 Fc region, IgG4 Fc region, IgM Fc region, IgA Fc region, IgD Fc region and IgE Fc region (see, e.g., Padlan, Molecular Immunology, 31(3), 169-217 (1993)). The term Fc monomer refers to the last two heavy chain constant regions of IgA, IgD, and IgG, and the last three heavy chain constant regions of IgE and IgM. The Fc monomer can also include the flexible hinge N-terminal to these domains. For IgA and IgM, the Fc monomer may include the J chain. For IgG, the Fc portion comprises immunoglobulin domains CH2 and CH3 and the hinge between the first two domains and CH2. Although the boundaries of the Fc portion of an immunoglobulin may vary, an example for a human IgG heavy chain Fc portion comprising a functional hinge, CH2 and CH3 domain can be defined e.g. to comprise residues D231 (of the hinge domain) to P476 (of the C-terminus of the CH3 domain), or D231 to L476, respectively, for IgG4, wherein the numbering is according to Kabat.

The antibody construct of the invention may hence comprise in an N- to C-terminal order:

(a) the first binding domain;
(b) a peptide linker having an amino acid sequence selected from the group consisting of SEQ ID NOs: 286, 292 and 293;
(c) the second binding domain;
(d) a peptide linker having an amino acid sequence selected from the group consisting of SEQ ID NOs: 285, 286, 288, 289, 290, 292 and 293;
(e) the first polypeptide monomer of the third domain (comprising a hinge, a CH2 and a CH3 domain);
(f) a peptide linker having an amino acid sequence selected from the group consisting of SEQ ID NOs: 550, 551, 552 and 553; and
(g) the second polypeptide monomer of the third domain (comprising a hinge, a CH2 and a CH3 domain).

It is also preferred that the antibody construct of the invention comprises in an N- to C-terminal order:

the first binding domain having an amino acid sequence selected from the group consisting of SEQ ID NO: 39, SEQ ID NO: 49, SEQ ID NO: 59, SEQ ID NO: 69, SEQ ID NO: 79, SEQ ID NO: 89, SEQ ID NO: 99, SEQ ID NO: 109, SEQ ID NO: 119, SEQ ID NO: 129, SEQ ID NO: 139, SEQ ID NO: 149, SEQ ID NO: 159, SEQ ID NO: 169, SEQ ID NO: 437, SEQ ID NO: 471, SEQ ID NO: 472, SEQ ID NO: 473, SEQ ID NO: 474, SEQ ID NO: 475, SEQ ID NO: 476, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 485, SEQ ID NO: 486, SEQ ID NO: 487, SEQ ID NO: 488, SEQ ID NO: 489, SEQ ID NO: 490, SEQ ID NO: 491, SEQ ID NO: 492, SEQ ID NO: 493, and SEQ ID NO: 531;

a peptide linker having an amino acid sequence selected from the group consisting of SEQ ID NOs: 286, 292 and 293;

the second binding domain having an amino acid sequence selected from the group consisting of SEQ ID NO: 350, SEQ ID NO: 359, SEQ ID NO: 368, SEQ ID NO: 377, SEQ ID NO: 386, SEQ ID NO: 395, SEQ ID NO: 404, SEQ ID NO: 413, SEQ ID NO: 422, SEQ ID NO: 431, and SEQ ID NO: 434;

a peptide linker having an amino acid sequence selected from the group consisting of SEQ ID NOs: 285, 286, 288, 289, 290, 292 and 293; and the third domain having an amino acid sequence selected from the group consisting of SEQ ID NOs: 541-548.

Hence, in a preferred embodiment, the antibody construct of the present invention comprises or consists of a polypeptide selected from the group consisting of those depicted in SEQ ID NO: 517, SEQ ID NO: 518, SEQ ID NO: 519, SEQ ID NO: 520, SEQ ID NO: 521, SEQ ID NO: 522, SEQ ID NO: 523, SEQ ID NO: 524, SEQ ID NO: 525, SEQ ID NO: 526, SEQ ID NO: 527, and SEQ ID NO: 528.

The sequence table (Table 18) also provides sequence variations of the binders denominated DLL3-4 and DLL3-14. The point mutations that were inserted into these sequence variants are identified according to the position of this mutation within the respective scFv molecule. It is understood that an alternative way of identifying these positions is also possible, depending on the polypeptide of reference, which could as well be the CDR region or the VH/VL region. For example, the variant denominated DLL3-4-001 has a G44C-G243C double mutation in its scFv molecule (SEQ ID NO: 437). This translates into a G44C mutation in the corresponding VH chain (SEQ ID NO: 435) and a G101C mutation in the corresponding VL chain (SEQ ID NO: 436).

Covalent modifications of the antibody constructs are also included within the scope of this invention, and are generally, but not always, done post-translationally. For example, several types of covalent modifications of the antibody construct are introduced into the molecule by reacting specific amino acid residues of the antibody construct with an organic derivatizing agent that is capable of reacting with selected side chains or the N- or C-terminal residues.

Cysteinyl residues most commonly are reacted with α-haloacetates (and corresponding amines), such as chloroacetic acid or chloroacetamide, to give carboxymethyl or carboxyamidomethyl derivatives. Cysteinyl residues also are derivatized by reaction with bromotrifluoroacetone, α-bromo-β-(5-imidozoyl)propionic acid, chloroacetyl phosphate, N-alkylmaleimides, 3-nitro-2-pyridyl disulfide, methyl 2-pyridyl disulfide, p-chloromercuribenzoate, 2-chloromercuri-4-nitrophenol, or chloro-7-nitrobenzo-2-oxa-1,3-diazole.

Histidyl residues are derivatized by reaction with diethylpyrocarbonate at pH 5.5-7.0 because this agent is relatively specific for the histidyl side chain. Para-bromophenacyl bromide also is useful; the reaction is preferably performed in 0.1 M sodium cacodylate at pH 6.0. Lysinyl and amino terminal residues are reacted with succinic or other carboxylic acid anhydrides. Derivatization with these agents has the effect of reversing the charge of the lysinyl residues. Other suitable reagents for derivatizing alpha-amino-containing residues include imidoesters such as methyl picolinimidate; pyridoxal phosphate; pyridoxal; chloroborohydride; trinitrobenzenesulfonic acid; O-methylisourea; 2,4-pentanedione; and transaminase-catalyzed reaction with glyoxylate.

Arginyl residues are modified by reaction with one or several conventional reagents, among them phenylglyoxal, 2,3-butanedione, 1,2-cyclohexanedione, and ninhydrin. Derivatization of arginine residues requires that the reaction be performed in alkaline conditions because of the high pKa of the guanidine functional group. Furthermore, these reagents may react with the groups of lysine as well as the arginine epsilon-amino group.

The specific modification of tyrosyl residues may be made, with particular interest in introducing spectral labels into tyrosyl residues by reaction with aromatic diazonium compounds or tetranitromethane. Most commonly, N-acetylimidizole and tetranitromethane are used to form O-acetyl tyrosyl species and 3-nitro derivatives, respectively. Tyrosyl residues are iodinated using $^{125}I$ or $^{131}I$ to prepare labeled proteins for use in radioimmunoassay, the chloramine T method described above being suitable.

Carboxyl side groups (aspartyl or glutamyl) are selectively modified by reaction with carbodiimides (R'—N=C=N—R'), where R and R' are optionally different alkyl groups, such as 1-cyclohexyl-3-(2-morpholinyl-4-ethyl) carbodiimide or 1-ethyl-3-(4-azonia-4,4-dimethylpentyl) carbodiimide. Furthermore, aspartyl and glutamyl residues are converted to asparaginyl and glutaminyl residues by reaction with ammonium ions.

Derivatization with bifunctional agents is useful for crosslinking the antibody constructs of the present invention to a water-insoluble support matrix or surface for use in a variety of methods. Commonly used crosslinking agents include, e.g., 1,1-bis(diazoacetyl)-2-phenylethane, glutaraldehyde, N-hydroxysuccinimide esters, for example, esters with 4-azidosalicylic acid, homobifunctional imidoesters, including disuccinimidyl esters such as 3,3'-dithiobis(succinimidylpropionate), and bifunctional maleimides such as bis-N-maleimido-1,8-octane. Derivatizing agents such as methyl-3-[(p-azidophenyl)dithio]propioimidate yield photoactivatable intermediates that are capable of forming crosslinks in the presence of light. Alternatively, reactive water-insoluble matrices such as cyanogen bromide-activated carbohydrates and the reactive substrates as described in U.S. Pat. Nos. 3,969,287; 3,691,016; 4,195,128; 4,247,642; 4,229,537; and 4,330,440 are employed for protein immobilization.

Glutaminyl and asparaginyl residues are frequently deamidated to the corresponding glutamyl and aspartyl residues, respectively. Alternatively, these residues are deamidated under mildly acidic conditions. Either form of these residues falls within the scope of this invention.

Other modifications include hydroxylation of proline and lysine, phosphorylation of hydroxyl groups of seryl or threonyl residues, methylation of the α-amino groups of lysine, arginine, and histidine side chains (T. E. Creighton, Proteins: Structure and Molecular Properties, W. H. Freeman & Co., San Francisco, 1983, pp. 79-86), acetylation of the N-terminal amine, and amidation of any C-terminal carboxyl group.

Another type of covalent modification of the antibody constructs included within the scope of this invention comprises altering the glycosylation pattern of the protein. As is known in the art, glycosylation patterns can depend on both the sequence of the protein (e.g., the presence or absence of particular glycosylation amino acid residues, discussed below), or the host cell or organism in which the protein is produced. Particular expression systems are discussed below.

Glycosylation of polypeptides is typically either N-linked or O-linked. N-linked refers to the attachment of the carbohydrate moiety to the side chain of an asparagine residue. The tri-peptide sequences asparagine-X-serine and asparagine-X-threonine, where X is any amino acid except proline, are the recognition sequences for enzymatic attachment of the carbohydrate moiety to the asparagine side chain. Thus, the presence of either of these tri-peptide sequences in a polypeptide creates a potential glycosylation site. O-linked glycosylation refers to the attachment of one of the sugars N-acetylgalactosamine, galactose, or xylose, to a hydroxyamino acid, most commonly serine or threonine, although 5-hydroxyproline or 5-hydroxylysine may also be used.

Addition of glycosylation sites to the antibody construct is conveniently accomplished by altering the amino acid sequence such that it contains one or more of the above-described tri-peptide sequences (for N-linked glycosylation sites). The alteration may also be made by the addition of, or substitution by, one or more serine or threonine residues to the starting sequence (for O-linked glycosylation sites). For ease, the amino acid sequence of an antibody construct is preferably altered through changes at the DNA level, particularly by mutating the DNA encoding the polypeptide at preselected bases such that codons are generated that will translate into the desired amino acids.

Another means of increasing the number of carbohydrate moieties on the antibody construct is by chemical or enzymatic coupling of glycosides to the protein. These procedures are advantageous in that they do not require production of the protein in a host cell that has glycosylation capabilities for N- and O-linked glycosylation. Depending on the coupling mode used, the sugar(s) may be attached to (a) arginine and histidine, (b) free carboxyl groups, (c) free sulfhydryl groups such as those of cysteine, (d) free hydroxyl groups such as those of serine, threonine, or hydroxyproline, (e) aromatic residues such as those of phenylalanine, tyrosine, or tryptophan, or (f) the amide group of glutamine. These methods are described in WO 87/05330, and in Aplin and Wriston, 1981, CRC Crit. Rev. Biochem., pp. 259-306.

Removal of carbohydrate moieties present on the starting antibody construct may be accomplished chemically or enzymatically. Chemical deglycosylation requires exposure of the protein to the compound trifluoromethanesulfonic acid, or an equivalent compound. This treatment results in the cleavage of most or all sugars except the linking sugar (N-acetylglucosamine or N-acetylgalactosamine), while leaving the polypeptide intact. Chemical deglycosylation is described by Hakimuddin et al., 1987, Arch. Biochem. Biophys. 259:52 and by Edge et al., 1981, Anal. Biochem. 118:131. Enzymatic cleavage of carbohydrate moieties on polypeptides can be achieved by the use of a variety of endo- and exo-glycosidases as described by Thotakura et al., 1987, Meth. Enzymol. 138:350. Glycosylation at potential glycosylation sites may be prevented by the use of the compound tunicamycin as described by Duskin et al., 1982, J. Biol. Chem. 257:3105. Tunicamycin blocks the formation of protein-N-glycoside linkages.

Other modifications of the antibody construct are also contemplated herein. For example, another type of covalent modification of the antibody construct comprises linking the antibody construct to various non-proteinaceous polymers, including, but not limited to, various polyols such as polyethylene glycol, polypropylene glycol, polyoxyalkylenes, or copolymers of polyethylene glycol and polypropylene glycol, in the manner set forth in U.S. Pat. Nos. 4,640,835; 4,496,689; 4,301,144; 4,670,417; 4,791,192 or 4,179,337. In addition, as is known in the art, amino acid substitutions may be made in various positions within the antibody construct, e.g. in order to facilitate the addition of polymers such as PEG.

In some embodiments, the covalent modification of the antibody constructs of the invention comprises the addition of one or more labels. The labelling group may be coupled to the antibody construct via spacer arms of various lengths to reduce potential steric hindrance. Various methods for labelling proteins are known in the art and can be used in performing the present invention. The term "label" or "labelling group" refers to any detectable label. In general, labels fall into a variety of classes, depending on the assay in which they are to be detected—the following examples include, but are not limited to:

isotopic labels, which may be radioactive or heavy isotopes, such as radioisotopes or radionuclides (e.g., 3H, 14C, 15N, 35S, 89Zr, 90Y, 99Tc, 111In, 125I, 131I)

magnetic labels (e.g., magnetic particles)

redox active moieties optical dyes (including, but not limited to, chromophores, phosphors and fluorophores) such as fluorescent groups (e.g., FITC, rhodamine, lanthanide phosphors), chemiluminescent groups, and fluorophores which can be either "small molecule" fluores or proteinaceous fluores enzymatic groups (e.g. horseradish peroxidase, β-galactosidase, luciferase, alkaline phosphatase)

biotinylated groups predetermined polypeptide epitopes recognized by a secondary reporter (e.g., leucine zipper pair sequences, binding sites for secondary antibodies, metal binding domains, epitope tags, etc.)

By "fluorescent label" is meant any molecule that may be detected via its inherent fluorescent properties. Suitable fluorescent labels include, but are not limited to, fluorescein, rhodamine, tetramethylrhodamine, eosin, erythrosin, coumarin, methyl-coumarins, pyrene, Malacite green, stilbene, Lucifer Yellow, Cascade BlueJ, Texas Red, IAEDANS, EDANS, BODIPY FL, LC Red 640, Cy 5, Cy 5.5, LC Red 705, Oregon green, the Alexa-Fluor dyes (Alexa Fluor 350, Alexa Fluor 430, Alexa Fluor 488, Alexa Fluor 546, Alexa Fluor 568, Alexa Fluor 594, Alexa Fluor 633, Alexa Fluor 660, Alexa Fluor 680), Cascade Blue, Cascade Yellow and R-phycoerythrin (PE) (Molecular Probes, Eugene, Oreg.), FITC, Rhodamine, and Texas Red (Pierce, Rockford, Ill.), Cy5, Cy5.5, Cy7 (Amersham Life Science, Pittsburgh, Pa.). Suitable optical dyes, including fluorophores, are described in Molecular Probes Handbook by Richard P. Haugland.

Suitable proteinaceous fluorescent labels also include, but are not limited to, green fluorescent protein, including a *Renilla, Ptilosarcus,* or *Aequorea* species of GFP (Chalfie et al., 1994, Science 263:802-805), EGFP (Clontech Laboratories, Inc., Genbank Accession Number U55762), blue fluorescent protein (BFP, Quantum Biotechnologies, Inc. 1801 de Maisonneuve Blvd. West, 8th Floor, Montreal, Quebec, Canada H3H 1J9; Stauber, 1998, Biotechniques 24:462-471; Heim et al., 1996, Curr. Biol. 6:178-182), enhanced yellow fluorescent protein (EYFP, Clontech Laboratories, Inc.), luciferase (Ichiki et al., 1993, J. Immunol. 150:5408-5417), β galactosidase (Nolan et al., 1988, Proc. Natl. Acad. Sci. U.S.A. 85:2603-2607) and *Renilla* (WO92/15673, WO95/07463, WO98/14605, WO98/26277, WO99/49019, U.S. Pat. Nos. 5,292,658; 5,418,155; 5,683,888; 5,741,668; 5,777,079; 5,804,387; 5,874,304; 5,876,995; 5,925,558).

Leucine zipper domains are peptides that promote oligomerization of the proteins in which they are found. Leucine zippers were originally identified in several DNA-binding proteins (Landschulz et al., 1988, Science 240: 1759), and have since been found in a variety of different proteins. Among the known leucine zippers are naturally occurring peptides and derivatives thereof that dimerize or trimerize. Examples of leucine zipper domains suitable for producing soluble oligomeric proteins are described in PCT application WO 94/10308, and the leucine zipper derived from lung surfactant protein D (SPD) described in Hoppe et al., 1994, FEBS Letters 344:191. The use of a modified leucine zipper that allows for stable trimerization of a heterologous protein fused thereto is described in Fanslow et al., 1994, Semin. Immunol. 6:267-78. In one approach, recombinant fusion proteins comprising a DLL3 antibody fragment or derivative fused to a leucine zipper peptide are expressed in suitable host cells, and the soluble oligomeric DLL3 antibody fragments or derivatives that form are recovered from the culture supernatant.

The antibody construct of the invention may also comprise additional domains, which are e.g. helpful in the isolation of the molecule or relate to an adapted pharmacokinetic profile of the molecule. Domains helpful for the isolation of an antibody construct may be selected from peptide motives or secondarily introduced moieties, which can be captured in an isolation method, e.g. an isolation column. Non-limiting embodiments of such additional domains comprise peptide motives known as Myc-tag, HAT-tag, HA-tag, TAP-tag, GST-tag, chitin binding domain (CBD-tag), maltose binding protein (MBP-tag), Flag-tag, Strep-tag and variants thereof (e.g. StrepII-tag) and His-tag. All herein disclosed antibody constructs characterized by the identified CDRs are preferred to comprise a His-tag domain, which is generally known as a repeat of consecutive His residues in the amino acid sequence of a molecule, preferably of five, and more preferably of six His residues (hexa-histidine). The His-tag may be located e.g. at the N- or C-terminus of the antibody construct, preferably it is located at the C-terminus. Most preferably, a hexa-histidine tag (HHHHHH) is linked via peptide bond to the C-terminus of the antibody construct according to the invention.

The first binding domain of the antibody construct of the present invention binds to human DLL3 on the surface of a target cell. The preferred amino acid sequence of human DLL3 is represented by SEQ ID NO: 252. It is understood that the term "on the surface", in the context of the present invention, means that the binding domain specifically binds to an epitope comprised within the DLL3 extracellular domain (DLL3 ECD). The first binding domain according to the invention hence preferably binds to DLL3 when it is expressed by naturally expressing cells or cell lines, and/or by cells or cell lines transformed or (stably/transiently) transfected with DLL3. In a preferred embodiment the first binding domain also binds to DLL3 when DLL3 is used as a "target" or "ligand" molecule in an in vitro binding assay such as BIAcore or Scatchard. The "target cell" can be any prokaryotic or eukaryotic cell expressing DLL3 on its surface; preferably the target cell is a cell that is part of the human or animal body, such as a specific DLL3 expressing cancer or tumor cell.

The term "DLL3 ECD" refers to a form of DLL3 which is essentially free of transmembrane and cytoplasmic domains of DLL3. It will be understood by the skilled artisan that the transmembrane domain identified for the DLL3 polypeptide of the present invention is identified pursuant to criteria routinely employed in the art for identifying that type of hydrophobic domain. The exact boundaries of a transmembrane domain may vary but most likely by no more than about 5 amino acids at either end of the domain specifically mentioned herein. A preferred human DLL3 ECD is shown in SEQ ID NO: 253.

The affinity of the first binding domain for human DLL3 is preferably ≤520 nM, more preferably ≤510 nM, even more preferably ≤55 nM, even more preferably ≤52 nM, even more preferably ≤51 nM, even more preferably ≤50.6 nM, even more preferably ≤50.5 nM, and most preferably ≤50.4 nM. The affinity can be measured for example in a BIAcore assay or in a Scatchard assay, e.g. as described in the Examples. Other methods of determining the affinity are also well-known to the skilled person.

T cells or T lymphocytes are a type of lymphocyte (itself a type of white blood cell) that play a central role in cell-mediated immunity. There are several subsets of T cells, each with a distinct function. T cells can be distinguished from other lymphocytes, such as B cells and NK cells, by the presence of a T cell receptor (TCR) on the cell surface. The TCR is responsible for recognizing antigens bound to major histocompatibility complex (MHC) molecules and is composed of two different protein chains. In 95% of the T cells, the TCR consists of an alpha (α) and beta (β) chain. When the TCR engages with antigenic peptide and MHC (peptide/MHC complex), the T lymphocyte is activated through a series of biochemical events mediated by associated enzymes, co-receptors, specialized adaptor molecules, and activated or released transcription factors.

The CD3 receptor complex is a protein complex and is composed of four chains. In mammals, the complex contains a CD3γ (gamma) chain, a CD3δ (delta) chain, and two CD3ε (epsilon) chains. These chains associate with the T cell receptor (TCR) and the so-called ζ (zeta) chain to form the T cell receptor CD3 complex and to generate an activation signal in T lymphocytes. The CD3γ (gamma), CD3δ (delta), and CD3ε (epsilon) chains are highly related cell-surface proteins of the immunoglobulin superfamily containing a single extracellular immunoglobulin domain. The intracellular tails of the CD3 molecules contain a single conserved motif known as an immunoreceptor tyrosine-based activation motif or ITAM for short, which is essential for the signaling capacity of the TCR. The CD3 epsilon molecule is a polypeptide which in humans is encoded by the CD3E gene which resides on chromosome 11. The most preferred epitope of CD3 epsilon is comprised within amino acid residues 1-27 of the human CD3 epsilon extracellular domain.

The redirected lysis of target cells via the recruitment of T cells by a multispecific, at least bispecific, antibody construct involves cytolytic synapse formation and delivery of perforin and granzymes. The engaged T cells are capable of serial target cell lysis, and are not affected by immune escape mechanisms interfering with peptide antigen processing and presentation, or clonal T cell differentiation; see, for example, WO 2007/042261.

Cytotoxicity mediated by DLL3×CD3 bispecific antibody constructs can be measured in various ways. See Examples 8.1 to 8.7. Effector cells can be e.g. stimulated enriched (human) CD8 positive T cells or unstimulated (human) peripheral blood mononuclear cells (PBMC). If the target cells are of macaque origin or express or are transfected with macaque DLL3, the effector cells should also be of macaque origin such as a macaque T cell line, e.g. 4119LnPx. The target cells should express (at least the extracellular domain of) DLL3, e.g. human or macaque DLL3. Target cells can be a cell line (such as CHO) which is stably or transiently transfected with DLL3, e.g. human or macaque DLL3. Alternatively, the target cells can be a DLL3 positive natural expresser cell line, such as the human lung carcinoma cell line SHP-77. Usually EC50 values are expected to be lower with target cell lines expressing higher levels of DLL3 on the cell surface. The effector to target cell (E:T) ratio is usually about 10:1, but can also vary. Cytotoxic activity of DLL3×CD3 bispecific antibody constructs can be measured in a 51-chromium release assay (incubation time of about 18 hours) or in a in a FACS-based cytotoxicity assay (incubation time of about 48 hours). Modifications of the assay incubation time (cytotoxic reaction) are also possible. Other methods of measuring cytotoxicity are well-known to the skilled person and comprise MTT or MTS assays, ATP-based assays including bioluminescent assays, the sulforhodamine B (SRB) assay, WST assay, clonogenic assay and the ECIS technology.

The cytotoxic activity mediated by DLL3×CD3 bispecific antibody constructs of the present invention is preferably measured in a cell-based cytotoxicity assay. It may also be measured in a 51-chromium release assay. It is represented by the EC50 value, which corresponds to the half maximal effective concentration (concentration of the antibody construct which induces a cytotoxic response halfway between the baseline and maximum). Preferably, the EC50 value of the DLL3×CD3 bispecific antibody constructs is ≤5000 pM or ≤4000 pM, more preferably ≤3000 pM or ≤2000 pM, even more preferably ≤1000 pM or ≤500 pM, even more preferably ≤400 pM or ≤300 pM, even more preferably ≤200 pM, even more preferably ≤100 pM, even more preferably ≤50 pM, even more preferably ≤20 pM or ≤10 pM, and most preferably ≤5 pM.

The above given EC50 values can be measured in different assays. The skilled person is aware that an EC50 value can be expected to be lower when stimulated/enriched CD8+ T cells are used as effector cells, compared with unstimulated PBMC. It can furthermore be expected that the EC50 values are lower when the target cells express a high number of the target antigen compared with a low target expression rat. For example, when stimulated/enriched human CD8+ T cells are used as effector cells (and either DLL3 transfected cells such as CHO cells or a DLL3 positive human lung carcinoma cell line SHP-77 are used as target cells), the EC50 value of the DLL3×CD3 bispecific antibody construct is preferably ≤1000 pM, more preferably ≤500 pM, even more preferably ≤250 pM, even more preferably ≤100 pM, even more preferably ≤50 pM, even more preferably ≤10 pM, and most preferably ≤5 pM. When human PBMCs are used as effector cells, the EC50 value of the DLL3×CD3 bispecific antibody construct is preferably ≤5000 pM or ≤4000 pM (in particular when the target cells are a DLL3 positive human lung carcinoma cell line SHP-77), more preferably ≤2000 pM (in particular when the target cells are DLL3 transfected cells such as CHO cells), more preferably ≤1000 pM or ≤500 pM, even more preferably ≤200 pM, even more preferably ≤150 pM, even more preferably ≤100 pM, and most preferably ≤50 pM, or lower. When a macaque T cell line such as LnPx4119 is used as effector cells, and a macaque DLL3 transfected cell line such as CHO cells is used as target cell line, the EC50 value of the DLL3×CD3 bispecific antibody construct is preferably ≤2000 pM or ≤1500 pM, more preferably ≤1000 pM or ≤500 pM, even more preferably ≤300 pM or ≤250 pM, even more preferably ≤100 pM, and most preferably ≤50 pM.

Preferably, the DLL3×CD3 bispecific antibody constructs of the present invention do not induce/mediate lysis or do not essentially induce/mediate lysis of DLL3 negative cells such as CHO cells. The term "do not induce lysis", "do not essentially induce lysis", "do not mediate lysis" or "do not essentially mediate lysis" means that an antibody construct of the present invention does not induce or mediate lysis of more than 30%, preferably not more than 20%, more preferably not more than 10%, particularly preferably not more than 9%, 8%, 7%, 6% or 5% of DLL3 negative cells, whereby lysis of a DLL3 positive human lung carcinoma cell line SHP-77 (see above) is set to be 100%. This usually applies for concentrations of the antibody construct of up to 500 nM. The skilled person knows how to measure cell lysis without further ado. Moreover, the present specification teaches specific instructions how to measure cell lysis.

The difference in cytotoxic activity between the monomeric and the dimeric isoform of individual DLL3×CD3 bispecific antibody constructs is referred to as "potency gap". This potency gap can e.g. be calculated as ratio between EC50 values of the molecule's monomeric and dimeric form, see Example 15. Potency gaps of the DLL3× CD3 bispecific antibody constructs of the present invention are preferably ≤5, more preferably ≤4, even more preferably ≤3, even more preferably ≤2 and most preferably ≤1.

The first and/or the second (or any further) binding domain(s) of the antibody construct of the invention is/are preferably cross-species specific for members of the mammalian order of primates. Cross-species specific CD3 binding domains are, for example, described in WO 2008/119567. According to one embodiment, the first and/or second binding domain, in addition to binding to human DLL3 and human CD3, respectively, will also bind to DLL3/CD3 of primates including (but not limited to) new world primates (such as *Callithrix jacchus, Saguinus Oedipus* or *Saimiri sciureus*), old world primates (such as baboons and macaques), gibbons, orangutans and non-human homininae. It is envisaged that the first binding domain of the antibody construct of the invention which binds to human DLL3 on the surface of a target cell also binds at least to macaque DLL3, and/or the second binding domain which binds to human CD3 on the surface of a T cell also binds at least to macaque CD3. A preferred macaque is *Macaca fascicularis*. *Macaca mulatta* (Rhesus) is also envisaged.

A preferred bispecific antibody construct of the invention comprises a first binding domain which binds to human DLL3 on the surface of a target cell and a second binding domain which binds to human CD3 on the surface of a T cell and at least macaque CD3. In one aspect of this embodiment, the first binding domain binds to an epitope of DLL3 which is comprised within the region as depicted in SEQ ID NO: 260.

In one aspect of the invention, the first binding domain binds to human DLL3 and further binds to macaque DLL3, such as DLL3 of *Macaca fascicularis*, and more preferably, to macaque DLL3 ECD. A preferred *Macaca fascicularis* DLL3 is depicted in SEQ ID NO: 271. A preferred macaque DLL3 ECD is depicted in SEQ ID NO: 272. The affinity of the first binding domain for macaque DLL3 is preferably ≤15 nM, more preferably ≤10 nM, even more preferably ≤5 nM, even more preferably ≤1 nM, even more preferably ≤0.5 nM, even more preferably ≤0.1 nM, and most preferably ≤0.05 nM or even ≤0.01 nM.

Preferably the affinity gap of the antibody constructs according to the invention for binding macaque DLL3 versus human DLL3 [ma DLL3:hu DLL3] (as determined e.g. by BiaCore or by Scatchard analysis) is between 0.1 and 10, more preferably between 0.2 and 5, even more preferably between 0.3 and 4, even more preferably between 0.5 and 3 or between 0.5 and 2.5, and most preferably between 0.5 and 2 or between 0.6 and 2. See Examples 3 and 4.

In one embodiment of the antibody construct of the invention, the second binding domain binds to human CD3 epsilon and to *Callithrix jacchus, Saguinus Oedipus* or *Saimiri sciureus* CD3 epsilon. Preferably, the second binding domain binds to an extracellular epitope of these CD3 epsilon chains. It is also envisaged that the second binding domain binds to an extracellular epitope of the human and the *Macaca* CD3 epsilon chain. The most preferred epitope of CD3 epsilon is comprised within amino acid residues 1-27 of the human CD3 epsilon extracellular domain. Even more specifically, the epitope comprises at least the amino acid sequence Gln-Asp-Gly-Asn-Glu. *Callithrix jacchus* and *Saguinus oedipus* are both new world primate belonging to the family of Callitrichidae, while *Saimiri sciureus* is a new world primate belonging to the family of Cebidae.

It is particularly preferred for the antibody construct of the present invention that the second binding domain which binds to human CD3 on the surface of a T cell comprises a VL region comprising CDR-L1, CDR-L2 and CDR-L3 selected from:

(a) CDR-L1 as depicted in SEQ ID NO: 27 of WO 2008/119567, CDR-L2 as depicted in SEQ ID NO: 28 of WO 2008/119567 and CDR-L3 as depicted in SEQ ID NO: 29 of WO 2008/119567;

(b) CDR-L1 as depicted in SEQ ID NO: 117 of WO 2008/119567, CDR-L2 as depicted in SEQ ID NO: 118 of WO 2008/119567 and CDR-L3 as depicted in SEQ ID NO: 119 of WO 2008/119567; and (c) CDR-L1 as depicted in SEQ ID NO: 153 of WO 2008/119567, CDR-L2 as depicted in SEQ ID NO: 154 of WO 2008/119567 and CDR-L3 as depicted in SEQ ID NO: 155 of WO 2008/119567.

In an alternatively preferred embodiment of the antibody construct of the present invention, the second binding domain which binds to human CD3 on the surface of a T cell comprises a VH region comprising CDR-H1, CDR-H2 and CDR-H3 selected from:

(a) CDR-H1 as depicted in SEQ ID NO: 12 of WO 2008/119567, CDR-H2 as depicted in SEQ ID NO: 13 of WO 2008/119567 and CDR-H3 as depicted in SEQ ID NO: 14 of WO 2008/119567;
(b) CDR-H1 as depicted in SEQ ID NO: 30 of WO 2008/119567, CDR-H2 as depicted in SEQ ID NO: 31 of WO 2008/119567 and CDR-H3 as depicted in SEQ ID NO: 32 of WO 2008/119567;
(c) CDR-H1 as depicted in SEQ ID NO: 48 of WO 2008/119567, CDR-H2 as depicted in SEQ ID NO: 49 of WO 2008/119567 and CDR-H3 as depicted in SEQ ID NO: 50 of WO 2008/119567;
(d) CDR-H1 as depicted in SEQ ID NO: 66 of WO 2008/119567, CDR-H2 as depicted in SEQ ID NO: 67 of WO 2008/119567 and CDR-H3 as depicted in SEQ ID NO: 68 of WO 2008/119567;
(e) CDR-H1 as depicted in SEQ ID NO: 84 of WO 2008/119567, CDR-H2 as depicted in SEQ ID NO: 85 of WO 2008/119567 and CDR-H3 as depicted in SEQ ID NO: 86 of WO 2008/119567;
(f) CDR-H1 as depicted in SEQ ID NO: 102 of WO 2008/119567, CDR-H2 as depicted in SEQ ID NO: 103 of WO 2008/119567 and CDR-H3 as depicted in SEQ ID NO: 104 of WO 2008/119567;
(g) CDR-H1 as depicted in SEQ ID NO: 120 of WO 2008/119567, CDR-H2 as depicted in SEQ ID NO: 121 of WO 2008/119567 and CDR-H3 as depicted in SEQ ID NO: 122 of WO 2008/119567;
(h) CDR-H1 as depicted in SEQ ID NO: 138 of WO 2008/119567, CDR-H2 as depicted in SEQ ID NO: 139 of WO 2008/119567 and CDR-H3 as depicted in SEQ ID NO: 140 of WO 2008/119567;
(i) CDR-H1 as depicted in SEQ ID NO: 156 of WO 2008/119567, CDR-H2 as depicted in SEQ ID NO: 157 of WO 2008/119567 and CDR-H3 as depicted in SEQ ID NO: 158 of WO 2008/119567; and
(j) CDR-H1 as depicted in SEQ ID NO: 174 of WO 2008/119567, CDR-H2 as depicted in SEQ ID NO: 175 of WO 2008/119567 and CDR-H3 as depicted in SEQ ID NO: 176 of WO 2008/119567.

It is further preferred for the antibody construct of the present invention that the second binding domain which binds to human CD3 on the surface of a T cell comprises a VL region selected from the group consisting of a VL region as depicted in SEQ ID NO: 35, 39, 125, 129, 161 or 165 of WO 2008/119567.

It is alternatively preferred that the second binding domain which binds to human CD3 on the surface of a T cell comprises a VH region selected from the group consisting of a VH region as depicted in SEQ ID NO: 15, 19, 33, 37, 51, 55, 69, 73, 87, 91, 105, 109, 123, 127, 141, 145, 159, 163, 177 or 181 of WO 2008/119567.

More preferably, the antibody construct of the present invention is characterized by the second binding domain which binds to human CD3 on the surface of a T cell comprising a VL region and a VH region selected from the group consisting of:
(a) a VL region as depicted in SEQ ID NO: 17 or 21 of WO 2008/119567 and a VH region as depicted in SEQ ID NO: 15 or 19 of WO 2008/119567;
(b) a VL region as depicted in SEQ ID NO: 35 or 39 of WO 2008/119567 and a VH region as depicted in SEQ ID NO: 33 or 37 of WO 2008/119567;
(c) a VL region as depicted in SEQ ID NO: 53 or 57 of WO 2008/119567 and a VH region as depicted in SEQ ID NO: 51 or 55 of WO 2008/119567;
(d) a VL region as depicted in SEQ ID NO: 71 or 75 of WO 2008/119567 and a VH region as depicted in SEQ ID NO: 69 or 73 of WO 2008/119567;
(e) a VL region as depicted in SEQ ID NO: 89 or 93 of WO 2008/119567 and a VH region as depicted in SEQ ID NO: 87 or 91 of WO 2008/119567;
(f) a VL region as depicted in SEQ ID NO: 107 or 111 of WO 2008/119567 and a VH region as depicted in SEQ ID NO: 105 or 109 of WO 2008/119567;
(g) a VL region as depicted in SEQ ID NO: 125 or 129 of WO 2008/119567 and a VH region as depicted in SEQ ID NO: 123 or 127 of WO 2008/119567;
(h) a VL region as depicted in SEQ ID NO: 143 or 147 of WO 2008/119567 and a VH region as depicted in SEQ ID NO: 141 or 145 of WO 2008/119567;
(i) a VL region as depicted in SEQ ID NO: 161 or 165 of WO 2008/119567 and a VH region as depicted in SEQ ID NO: 159 or 163 of WO 2008/119567; and
(j) a VL region as depicted in SEQ ID NO: 179 or 183 of WO 2008/119567 and a VH region as depicted in SEQ ID NO: 177 or 181 of WO 2008/119567.

According to a preferred embodiment of the antibody construct of the present invention, the binding domains and in particular the second binding domain (which binds to human CD3 on the surface of a T cell) have the following format: The pairs of VH regions and VL regions are in the format of a single chain antibody (scFv). The VH and VL regions are arranged in the order VH-VL or VL-VH. It is preferred that the VH-region is positioned N-terminally of a linker sequence, and the VL-region is positioned C-terminally of the linker sequence.

A preferred embodiment of the above described antibody construct of the present invention is characterized by the second binding domain which binds to human CD3 on the surface of a T cell comprising an amino acid sequence selected from the group consisting of SEQ ID NOs: 23, 25, 41, 43, 59, 61, 77, 79, 95, 97, 113, 115, 131, 133, 149, 151, 167, 169, 185 or 187 of WO 2008/119567.

Hence, in one embodiment, the antibody construct of the invention comprises a polypeptide selected from the group consisting of those depicted in SEQ ID NO: 40, SEQ ID NO: 50, SEQ ID NO: 60, SEQ ID NO: 70, SEQ ID NO: 80, SEQ ID NO: 90, SEQ ID NO: 100, SEQ ID NO: 110, SEQ ID NO: 120, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 438 and SEQ ID NO: 532. These antibody constructs have a first binding domain which binds to an epitope of DLL3 which is comprised within the region as depicted in SEQ ID NO: 258.

In an alternative embodiment, the antibody construct of the invention comprises a polypeptide selected from the group consisting of those depicted in SEQ ID NO: 130, SEQ ID NO: 140, SEQ ID NO: 150, SEQ ID NO: 160, SEQ ID NO: 170; SEQ ID NO: 218, SEQ ID NO: 219, SEQ ID NO: 220, SEQ ID NO: 494, SEQ ID NO: 495, SEQ ID NO: 496, SEQ ID NO: 497, SEQ ID NO: 498, SEQ ID NO: 499, SEQ ID NO: 500, SEQ ID NO: 501, SEQ ID NO: 502, SEQ ID NO: 503, SEQ ID NO: 504, SEQ ID NO: 505, SEQ ID NO: 506, SEQ ID NO: 507, SEQ ID NO: 508, SEQ ID NO: 509, SEQ ID NO: 510, SEQ ID NO: 511, SEQ ID NO: 512, SEQ ID NO: 513, SEQ ID NO: 514, SEQ ID NO: 515, and SEQ ID NO: 516. These antibody constructs have a first binding domain which binds to an epitope of DLL3 which is comprised within the region as depicted in SEQ ID NO: 259.

Amino acid sequence modifications of the antibody constructs described herein are also contemplated. For example, it may be desirable to improve the binding affinity and/or other biological properties of the antibody construct. Amino acid sequence variants of the antibody constructs are prepared by introducing appropriate nucleotide changes into the antibody constructs nucleic acid, or by peptide synthesis. All of the below described amino acid sequence modifications should result in an antibody construct which still retains the desired biological activity (binding to DLL3 and to CD3) of the unmodified parental molecule.

The term "amino acid" or "amino acid residue" typically refers to an amino acid having its art recognized definition such as an amino acid selected from the group consisting of: alanine (Ala or A); arginine (Arg or R); asparagine (Asn or N); aspartic acid (Asp or D); cysteine (Cys or C); glutamine (Gln or Q); glutamic acid (Glu or E); glycine (Gly or G); histidine (His or H); isoleucine (He or I): leucine (Leu or L); lysine (Lys or K); methionine (Met or M); phenylalanine (Phe or F); pro line (Pro or P); serine (Ser or S); threonine (Thr or T); tryptophan (Trp or W); tyrosine (Tyr or Y); and valine (Val or V), although modified, synthetic, or rare amino acids may be used as desired. Generally, amino acids can be grouped as having a nonpolar side chain (e.g., Ala, Cys, He, Leu, Met, Phe, Pro, Val); a negatively charged side chain (e.g., Asp, Glu); a positively charged sidechain (e.g., Arg, His, Lys); or an uncharged polar side chain (e.g., Asn, Cys, Gln, Gly, His, Met, Phe, Ser, Thr, Trp, and Tyr).

Amino acid modifications include, for example, deletions from, and/or insertions into, and/or substitutions of, residues within the amino acid sequences of the antibody constructs. Any combination of deletion, insertion, and substitution is made to arrive at the final construct, provided that the final construct possesses the desired characteristics. The amino acid changes also may alter post-translational processes of the antibody constructs, such as changing the number or position of glycosylation sites.

For example, 1, 2, 3, 4, 5, or 6 amino acids may be inserted or deleted in each of the CDRs (of course, dependent on their length), while 1, 2, 3, 4, 5, 6, 7, 8, 9, 10, 11, 12, 13, 14, 15, 16, 17, 18, 19, 20, or 25 amino acids may be inserted or deleted in each of the FRs. Preferably, amino acid sequence insertions include amino- and/or carboxyl-terminal fusions ranging in length from 1, 2, 3, 4, 5, 6, 7, 8, 9 or 10 residues to polypeptides containing a hundred or more residues, as well as intra-sequence insertions of single or multiple amino acid residues. An insertional variant of the antibody construct of the invention includes the fusion to the N-terminus or to the C-terminus of the antibody construct of an enzyme or the fusion to a polypeptide which increases the serum half-life of the antibody construct.

The sites of greatest interest for substitutional mutagenesis include the CDRs of the heavy and/or light chain, in particular the hypervariable regions, but FR alterations in the heavy and/or light chain are also contemplated. The substitutions are preferably conservative substitutions as described herein. Preferably, 1, 2, 3, 4, 5, 6, 7, 8, 9, or 10 amino acids may be substituted in a CDR, while 1, 2, 3, 4, 5, 6, 7, 8, 9, 10, 11, 12, 13, 14, 15, 16, 17, 18, 19, 20, or 25 amino acids may be substituted in the framework regions (FRs), depending on the length of the CDR or FR. For example, if a CDR sequence encompasses 6 amino acids, it is envisaged that one, two or three of these amino acids are substituted. Similarly, if a CDR sequence encompasses 15 amino acids it is envisaged that one, two, three, four, five or six of these amino acids are substituted.

A useful method for identification of certain residues or regions of the antibody constructs that are preferred locations for mutagenesis is called "alanine scanning mutagenesis" as described by Cunningham and Wells in Science, 244: 1081-1085 (1989). Here, a residue or group of target residues within the antibody construct is/are identified (e.g. charged residues such as arg, asp, his, lys, and glu) and replaced by a neutral or negatively charged amino acid (most preferably alanine or polyalanine) to affect the interaction of the amino acids with the epitope.

Those amino acid locations demonstrating functional sensitivity to the substitutions are then refined by introducing further or other variants at, or for, the sites of substitution. Thus, while the site or region for introducing an amino acid sequence variation is predetermined, the nature of the mutation per se needs not to be predetermined. For example, to analyze or optimize the performance of a mutation at a given site, alanine scanning or random mutagenesis may be conducted at a target codon or region, and the expressed antibody construct variants are screened for the optimal combination of desired activity. Techniques for making substitution mutations at predetermined sites in the DNA having a known sequence are well known, for example, M13 primer mutagenesis and PCR mutagenesis. Screening of the mutants is done using assays of antigen binding activities, such as DLL3 or CD3 binding.

Generally, if amino acids are substituted in one or more or all of the CDRs of the heavy and/or light chain, it is preferred that the then-obtained "substituted" sequence is at least 60% or 65%, more preferably 70% or 75%, even more preferably 80% or 85%, and particularly preferably 90% or 95% identical to the "original" CDR sequence. This means that it is dependent of the length of the CDR to which degree it is identical to the "substituted" sequence. For example, a CDR having 5 amino acids is preferably 80% identical to its substituted sequence in order to have at least one amino acid substituted. Accordingly, the CDRs of the antibody construct may have different degrees of identity to their substituted sequences, e.g., CDRL1 may have 80%, while CDRL3 may have 90%.

Preferred substitutions (or replacements) are conservative substitutions. However, any substitution (including non-conservative substitution or one or more from the "exemplary substitutions" listed in Table 1, below) is envisaged as long as the antibody construct retains its capability to bind to DLL3 via the first binding domain and to CD3 or CD3 epsilon via the second binding domain and/or its CDRs have an identity to the then substituted sequence (at least 60% or 65%, more preferably 70% or 75%, even more preferably 80% or 85%, and particularly preferably 90% or 95% identical to the "original" CDR sequence).

Conservative substitutions are shown in Table 1 under the heading of "preferred substitutions". If such substitutions result in a change in biological activity, then more substantial changes, denominated "exemplary substitutions" in Table 1, or as further described below in reference to amino acid classes, may be introduced and the products screened for a desired characteristic.

TABLE 1

Amino acid substitutions

| Original | Exemplary Substitutions | Preferred Substitutions |
|---|---|---|
| Ala (A) | val, leu, ile | val |
| Arg (R) | lys, gln, asn | lys |
| Asn (N) | gln, his, asp, lys, arg | gln |
| Asp (D) | glu, asn | glu |
| Cys (C) | ser, ala | ser |
| Gln (Q) | asn, glu | asn |

TABLE 1-continued

Amino acid substitutions

| Original | Exemplary Substitutions | Preferred Substitutions |
|---|---|---|
| Glu (E) | asp, gln | asp |
| Gly (G) | Ala | ala |
| His (H) | asn, gln, lys, arg | arg |
| Ile (I) | leu, val, met, ala, phe | leu |
| Leu (L) | norleucine, ile, val, met, ala | ile |
| Lys (K) | arg, gln, asn | arg |
| Met (M) | leu, phe, ile | leu |
| Phe (F) | leu, val, ile, ala, tyr | tyr |
| Pro (P) | Ala | ala |
| Ser (S) | Thr | thr |
| Thr (T) | Ser | ser |
| Trp (W) | tyr, phe | tyr |
| Tyr (Y) | trp, phe, thr, ser | phe |
| Val (V) | ile, leu, met, phe, ala | leu |

Substantial modifications in the biological properties of the antibody construct of the present invention are accomplished by selecting substitutions that differ significantly in their effect on maintaining (a) the structure of the polypeptide backbone in the area of the substitution, for example, as a sheet or helical conformation, (b) the charge or hydrophobicity of the molecule at the target site, or (c) the bulk of the side chain. Naturally occurring residues are divided into groups based on common side-chain properties: (1) hydrophobic: norleucine, met, ala, val, leu, ile; (2) neutral hydrophilic: cys, ser, thr; (3) acidic: asp, glu; (4) basic: asn, gln, his, lys, arg; (5) residues that influence chain orientation: gly, pro; and (6) aromatic: trp, tyr, phe.

Non-conservative substitutions will entail exchanging a member of one of these classes for another class. Any cysteine residue not involved in maintaining the proper conformation of the antibody construct may be substituted, generally with serine, to improve the oxidative stability of the molecule and prevent aberrant crosslinking. Conversely, cysteine bond(s) may be added to the antibody to improve its stability (particularly where the antibody is an antibody fragment such as an Fv fragment).

For amino acid sequences, sequence identity and/or similarity is determined by using standard techniques known in the art, including, but not limited to, the local sequence identity algorithm of Smith and Waterman, 1981, Adv. Appl. Math. 2:482, the sequence identity alignment algorithm of Needleman and Wunsch, 1970, J. Mol. Biol. 48:443, the search for similarity method of Pearson and Lipman, 1988, Proc. Nat. Acad. Sci. U.S.A. 85:2444, computerized implementations of these algorithms (GAP, BESTFIT, FASTA, and TFASTA in the Wisconsin Genetics Software Package, Genetics Computer Group, 575 Science Drive, Madison, Wis.), the Best Fit sequence program described by Devereux et al., 1984, Nucl. Acid Res. 12:387-395, preferably using the default settings, or by inspection. Preferably, percent identity is calculated by FastDB based upon the following parameters: mismatch penalty of 1; gap penalty of 1; gap size penalty of 0.33; and joining penalty of 30, "Current Methods in Sequence Comparison and Analysis," Macromolecule Sequencing and Synthesis, Selected Methods and Applications, pp 127-149 (1988), Alan R. Liss, Inc.

An example of a useful algorithm is PILEUP. PILEUP creates a multiple sequence alignment from a group of related sequences using progressive, pairwise alignments. It can also plot a tree showing the clustering relationships used to create the alignment. PILEUP uses a simplification of the progressive alignment method of Feng & Doolittle, 1987, J. Mol. Evol. 35:351-360; the method is similar to that described by Higgins and Sharp, 1989, CABIOS 5:151-153. Useful PILEUP parameters including a default gap weight of 3.00, a default gap length weight of 0.10, and weighted end gaps.

Another example of a useful algorithm is the BLAST algorithm, described in: Altschul et al., 1990, J. Mol. Biol. 215:403-410; Altschul et al., 1997, Nucleic Acids Res. 25:3389-3402; and Karin et al., 1993, Proc. Natl. Acad. Sci. U.S.A. 90:5873-5787. A particularly useful BLAST program is the WU-BLAST-2 program which was obtained from Altschul et al., 1996, Methods in Enzymology 266: 460-480. WU-BLAST-2 uses several search parameters, most of which are set to the default values. The adjustable parameters are set with the following values: overlap span=1, overlap fraction=0.125, word threshold (T)=II. The HSP S and HSP S2 parameters are dynamic values and are established by the program itself depending upon the composition of the particular sequence and composition of the particular database against which the sequence of interest is being searched; however, the values may be adjusted to increase sensitivity.

An additional useful algorithm is gapped BLAST as reported by Altschul et al., 1993, Nucl. Acids Res. 25:3389-3402. Gapped BLAST uses BLOSUM-62 substitution scores; threshold T parameter set to 9; the two-hit method to trigger ungapped extensions, charges gap lengths of k a cost of 10+k; Xu set to 16, and Xg set to 40 for database search stage and to 67 for the output stage of the algorithms. Gapped alignments are triggered by a score corresponding to about 22 bits.

Generally, the amino acid homology, similarity, or identity between individual variant CDRs are at least 60% to the sequences depicted herein, and more typically with preferably increasing homologies or identities of at least 65% or 70%, more preferably at least 75% or 80%, even more preferably at least 85%, 90%, 91%, 92%, 93%, 94%, 95%, 96%, 97%, 98%, 99%, and almost 100%. In a similar manner, "percent (%) nucleic acid sequence identity" with respect to the nucleic acid sequence of the binding proteins identified herein is defined as the percentage of nucleotide residues in a candidate sequence that are identical with the nucleotide residues in the coding sequence of the antibody construct. A specific method utilizes the BLASTN module of WU-BLAST-2 set to the default parameters, with overlap span and overlap fraction set to 1 and 0.125, respectively.

Generally, the nucleic acid sequence homology, similarity, or identity between the nucleotide sequences encoding individual variant CDRs and the nucleotide sequences depicted herein are at least 60%, and more typically with preferably increasing homologies or identities of at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, or 99%, and almost 100%. Thus, a "variant CDR" is one with the specified homology, similarity, or identity to the parent CDR of the invention, and shares biological function, including, but not limited to, at least 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, or 99% of the specificity and/or activity of the parent CDR.

In one embodiment, the percentage of identity to human germline of the antibody constructs according to the invention is ≥70% or ≥75%, more preferably ≥80% or ≥85%, even more preferably ≥90%, and most preferably ≥91%, ≥92%, ≥93%, ≥94%, ≥95% or even ≥96%. See Example 7. Identity to human antibody germline gene products is thought to be an important feature to reduce the risk of therapeutic proteins to elicit an immune response against the drug in the patient during treatment. Hwang & Foote ("Immunogenicity of engineered antibodies"; Methods 36 (2005) 3-10) demonstrate that the reduction of non-human portions of drug antibody constructs leads to a decrease of risk to induce anti-drug antibodies in the patients during treatment. By comparing an exhaustive number of clinically evaluated antibody drugs and the respective immunogenicity data, the trend is shown that humanization of the V-regions of antibodies makes the protein less immunogenic (average 5.1% of patients) than antibodies carrying unaltered non-human V regions (average 23.59% of patients). A higher degree of identity to human sequences is hence desirable for V-region based protein therapeutics in the form of antibody constructs. For this purpose of determining the germline identity, the V-regions of VL can be aligned with the amino acid sequences of human germline V segments and J segments (http colon-slash-slash vbase.mrc-cpe.cam.ac.uk/) using Vector NTI software and the amino acid sequence calculated by dividing the identical amino acid residues by the total number of amino acid residues of the VL in percent. The same can be for the VH segments (http colon-slash-slash vbase.mrc-cpe.cam.ac.uk/) with the exception that the VH CDR3 may be excluded due to its high diversity and a lack of existing human germline VH CDR3 alignment partners. Recombinant techniques can then be used to increase sequence identity to human antibody germline genes.

In a further embodiment, the bispecific antibody constructs of the present invention exhibit high monomer yields under standard research scale conditions, e.g., in a standard two-step purification process. Preferably the monomer yield of the antibody constructs according to the invention is ≥0.25 mg/L supernatant, more preferably ≥0.5 mg/L, even more preferably ≥1 mg/L, and most preferably ≥3 mg/L supernatant.

Likewise, the yield of the dimeric antibody construct isoforms and hence the monomer percentage (i.e., monomer: (monomer+dimer)) of the antibody constructs can be determined. The productivity of monomeric and dimeric antibody constructs and the calculated monomer percentage can e.g. be obtained in the SEC purification step of culture supernatant from standardized research-scale production in roller bottles. In one embodiment, the monomer percentage of the antibody constructs is ≥80%, more preferably ≥85%, even more preferably ≥90%, and most preferably ≥95%.

In one embodiment, the antibody constructs have a preferred plasma stability (ratio of EC50 with plasma to EC50 w/o plasma) of ≤5 or ≤4, more preferably ≤3.5 or ≤3, even more preferably ≤2.5 or ≤2, and most preferably ≤1.5 or ≤1. The plasma stability of an antibody construct can be tested by incubation of the construct in human plasma at 37° C. for 24 hours followed by EC50 determination in a 51-chromium release cytotoxicity assay. The effector cells in the cytotoxicity assay can be stimulated enriched human CD8 positive T cells. Target cells can e.g. be CHO cells transfected with human DLL3. The effector to target cell (E:T) ratio can be chosen as 10:1. The human plasma pool used for this purpose is derived from the blood of healthy donors collected by EDTA coated syringes. Cellular components are removed by centrifugation and the upper plasma phase is collected and subsequently pooled. As control, antibody constructs are diluted immediately prior to the cytotoxicity assay in RPMI-1640 medium. The plasma stability is calculated as ratio of EC50 (after plasma incubation) to EC50 (control). See Example 11.

It is furthermore preferred that the monomer to dimer conversion of antibody constructs of the invention is low. The conversion can be measured under different conditions and analyzed by high performance size exclusion chromatography. See Example 9. For example, incubation of the monomeric isoforms of the antibody constructs can be carried out for 7 days at 37° C. and concentrations of e.g. 100 µg/ml or 250 µg/ml in an incubator. Under these conditions, it is preferred that the antibody constructs of the invention show a dimer percentage that is ≤5%, more preferably ≤4%, even more preferably ≤3%, even more preferably ≤2.5%, even more preferably ≤2%, even more preferably ≤1.5%, and most preferably ≤1% or ≤0.5% or even 0%.

It is also preferred that the bispecific antibody constructs of the present invention present with very low dimer conversion after a number of freeze/thaw cycles. For example, the antibody construct monomer is adjusted to a concentration of 250 µg/ml e.g. in generic formulation buffer and subjected to three freeze/thaw cycles (freezing at −80° C. for 30 min followed by thawing for 30 min at room temperature), followed by high performance SEC to determine the percentage of initially monomeric antibody construct, which had been converted into dimeric antibody construct. Preferably the dimer percentages of the bispecific antibody constructs are ≤5%, more preferably ≤4%, even more preferably ≤3%, even more preferably ≤2.5%, even more preferably ≤2%, even more preferably ≤1.5%, and most preferably ≤1% or even ≤0.5%, for example after three freeze/thaw cycles.

The bispecific antibody constructs of the present invention preferably show a favorable thermostability with aggregation temperatures ≥45° C. or ≥50° C., more preferably ≥52° C. or ≥54° C., even more preferably ≥56° C. or ≥57° C., and most preferably ≥58° C. or ≥59° C. The thermostability parameter can be determined in terms of antibody aggregation temperature as follows: Antibody solution at a concentration 250 µg/ml is transferred into a single use cuvette and placed in a Dynamic Light Scattering (DLS) device. The sample is heated from 40° C. to 70° C. at a heating rate of 0.5° C./min with constant acquisition of the measured radius. Increase of radius indicating melting of the protein and aggregation is used to calculate the aggregation temperature of the antibody. See Example 10.

Alternatively, temperature melting curves can be determined by Differential Scanning Calorimetry (DSC) to determine intrinsic biophysical protein stabilities of the antibody constructs. These experiments are performed using a MicroCal LLC (Northampton, Mass., U.S.A.) VP-DSC device. The energy uptake of a sample containing an antibody construct is recorded from 20° C. to 90° C. compared to a sample containing only the formulation buffer. The antibody constructs are adjusted to a final concentration of 250 µg/ml e.g. in SEC running buffer. For recording of the respective melting curve, the overall sample temperature is increased stepwise. At each temperature T energy uptake of the sample and the formulation buffer reference is recorded. The difference in energy uptake Cp (kcal/mole/° C.) of the sample minus the reference is plotted against the respective temperature. The melting temperature is defined as the temperature at the first maximum of energy uptake.

It is furthermore envisaged that the DLL3×CD3 bispecific antibody constructs of the invention do not cross-react with (i.e., do not essentially bind to) the human DLL3 paralogues DLL1 and/or DLL4. Furthermore, it is envisaged that the DLL3×CD3 bispecific antibody constructs of the invention do not cross-react with (i.e., do not essentially bind to) the macaque/cyno DLL3 paralogues DLL1 and/or DLL4. See Example 6.

The DLL3×CD3 bispecific antibody constructs of the invention are also envisaged to have a turbidity (as measured by OD340 after concentration of purified monomeric antibody construct to 2.5 mg/ml and over night incubation) of ≤0.2, preferably of ≤0.15, more preferably of ≤0.12, even more preferably of ≤0.1, and most preferably of ≤0.08. See Example 12.

The DLL3×CD3 bispecific antibody constructs of the invention are also envisaged to not be internalized or to not undergo significant internalization by the target cell. The rate of internalization can be assayed e.g. as described in Example 16. Preferably, the internalization rate (e.g. measured as a decrease in cytotoxicity) is ≤20% after a 2 hour (pre-)incubation of the antibody construct with the target cell, more preferably ≤15%, even more preferably ≤10%, and most preferably ≤5%.

It is furthermore envisaged that shed or soluble DLL3 does not significantly impair the efficacy or biologic activity of the DLL3×CD3 bispecific antibody constructs of the invention. This can be measured e.g. in a cytotoxicity assay where soluble DLL3 is added at increasing concentrations to the assay, e.g. at 0 nM-0.3 nM-0.7 nM-1 nM-3 nM-7 nM-12 nM. The EC50 value of the tested antibody construct should not be significantly increased in the presence of soluble DLL3. See Example 17.

In a further embodiment the antibody construct according to the invention is stable at acidic pH. The more tolerant the antibody construct behaves at unphysiologic pH such as pH 5.5 (a pH which is required to run e.g. a cation exchange chromatography), the higher is the recovery of the antibody construct eluted from an ion exchange column relative to the total amount of loaded protein. Recovery of the antibody construct from an ion (e.g., cation) exchange column at pH 5.5 is preferably ≥30%, more preferably ≥40%, more preferably ≥50%, even more preferably ≥60%, even more preferably ≥70%, even more preferably ≥80%, even more preferably ≥90%, even more preferably ≥95%, and most preferably ≥99%. See Example 13.

It is furthermore envisaged that the bispecific antibody constructs of the present invention exhibit therapeutic efficacy or anti-tumor activity. This can e.g. be assessed in a study as disclosed in the following example of an advanced stage human tumor xenograft model:

On day 1 of the study, $5 \times 10^6$ cells of a human DLL3 positive cancer cell line (e.g. SHP-77) are subcutaneously injected in the right dorsal flank of female NOD/SCID mice. When the mean tumor volume reaches about 100 mm³, in vitro expanded human CD3 positive T cells are transplanted into the mice by injection of about $2 \times 10^7$ cells into the peritoneal cavity of the animals. Mice of vehicle control group 1 do not receive effector cells and are used as an untransplanted control for comparison with vehicle control group 2 (receiving effector cells) to monitor the impact of T cells alone on tumor growth. The antibody treatment starts when the mean tumor volume reaches about 200 mm³. The mean tumor size of each treatment group on the day of treatment start should not be statistically different from any other group (analysis of variance). Mice are treated with 0.5 mg/kg/day of a DLL3×CD3 bispecific antibody construct by intravenous bolus injection for about 15 to 20 days. Tumors are measured by caliper during the study and progress evaluated by intergroup comparison of tumor volumes (TV). The tumor growth inhibition T/C [%] is determined by calculating TV as T/C %=100×(median TV of analyzed group)/(median TV of control group 2).

The skilled person knows how to modify or adapt certain parameters of this study, such as the number of injected tumor cells, the site of injection, the number of transplanted human T cells, the amount of bispecific antibody constructs to be administered, and the timelines, while still arriving at a meaningful and reproducible result. Preferably, the tumor growth inhibition T/C [%] is ≤70 or ≤60, more preferably ≤50 or ≤40, even more preferably ≤30 or ≤20 and most preferably ≤10 or ≤5 or even ≤2.5.

The invention further provides a polynucleotide/nucleic acid molecule encoding an antibody construct of the invention.

A polynucleotide is a biopolymer composed of 13 or more nucleotide monomers covalently bonded in a chain. DNA (such as cDNA) and RNA (such as mRNA) are examples of polynucleotides with distinct biological function. Nucleotides are organic molecules that serve as the monomers or subunits of nucleic acid molecules like DNA or RNA. The nucleic acid molecule or polynucleotide can be double stranded and single stranded, linear and circular. It is preferably comprised in a vector which is preferably comprised in a host cell. Said host cell is, e.g. after transformation or transfection with the vector or the polynucleotide of the invention, capable of expressing the antibody construct. For that purpose the polynucleotide or nucleic acid molecule is operatively linked with control sequences.

The genetic code is the set of rules by which information encoded within genetic material (nucleic acids) is translated into proteins. Biological decoding in living cells is accomplished by the ribosome which links amino acids in an order specified by mRNA, using tRNA molecules to carry amino acids and to read the mRNA three nucleotides at a time. The code defines how sequences of these nucleotide triplets, called codons, specify which amino acid will be added next during protein synthesis. With some exceptions, a three-nucleotide codon in a nucleic acid sequence specifies a single amino acid. Because the vast majority of genes are encoded with exactly the same code, this particular code is often referred to as the canonical or standard genetic code. While the genetic code determines the protein sequence for a given coding region, other genomic regions can influence when and where these proteins are produced.

Furthermore, the invention provides a vector comprising a polynucleotide/nucleic acid molecule of the invention.

A vector is a nucleic acid molecule used as a vehicle to transfer (foreign) genetic material into a cell. The term "vector" encompasses—but is not restricted to—plasmids, viruses, cosmids and artificial chromosomes. In general, engineered vectors comprise an origin of replication, a multicloning site and a selectable marker. The vector itself is generally a nucleotide sequence, commonly a DNA sequence, that comprises an insert (transgene) and a larger sequence that serves as the "backbone" of the vector. Modern vectors may encompass additional features besides the transgene insert and a backbone: promoter, genetic marker, antibiotic resistance, reporter gene, targeting sequence, protein purification tag. Vectors called expression vectors (expression constructs) specifically are for the expression of the transgene in the target cell, and generally have control sequences.

The term "control sequences" refers to DNA sequences necessary for the expression of an operably linked coding sequence in a particular host organism. The control sequences that are suitable for prokaryotes, for example, include a promoter, optionally an operator sequence, and a ribosome binding site. Eukaryotic cells are known to utilize promoters, polyadenylation signals, and enhancers.

A nucleic acid is "operably linked" when it is placed into a functional relationship with another nucleic acid sequence. For example, DNA for a presequence or secretory leader is operably linked to DNA for a polypeptide if it is expressed as a preprotein that participates in the secretion of the polypeptide; a promoter or enhancer is operably linked to a coding sequence if it affects the transcription of the sequence; or a ribosome binding site is operably linked to a coding sequence if it is positioned so as to facilitate translation. Generally, "operably linked" means that the DNA sequences being linked are contiguous, and, in the case of a secretory leader, contiguous and in reading phase. However, enhancers do not have to be contiguous. Linking is accomplished by ligation at convenient restriction sites. If such sites do not exist, the synthetic oligonucleotide adaptors or linkers are used in accordance with conventional practice.

"Transfection" is the process of deliberately introducing nucleic acid molecules or polynucleotides (including vectors) into target cells. The term is mostly used for non-viral methods in eukaryotic cells. Transduction is often used to describe virus-mediated transfer of nucleic acid molecules or polynucleotides. Transfection of animal cells typically involves opening transient pores or "holes" in the cell membrane, to allow the uptake of material. Transfection can be carried out using calcium phosphate, by electroporation, by cell squeezing or by mixing a cationic lipid with the material to produce liposomes, which fuse with the cell membrane and deposit their cargo inside.

The term "transformation" is used to describe non-viral transfer of nucleic acid molecules or polynucleotides (including vectors) into bacteria, and also into non-animal eukaryotic cells, including plant cells. Transformation is hence the genetic alteration of a bacterial or non-animal eukaryotic cell resulting from the direct uptake through the cell membrane(s) from its surroundings and subsequent incorporation of exogenous genetic material (nucleic acid molecules). Transformation can be effected by artificial means. For transformation to happen, cells or bacteria must be in a state of competence, which might occur as a time-limited response to environmental conditions such as starvation and cell density.

Moreover, the invention provides a host cell transformed or transfected with the polynucleotide/nucleic acid molecule or with the vector of the invention.

As used herein, the terms "host cell" or "recipient cell" are intended to include any individual cell or cell culture that can be or has/have been recipients of vectors, exogenous nucleic acid molecules, and polynucleotides encoding the antibody construct of the present invention; and/or recipients of the antibody construct itself. The introduction of the respective material into the cell is carried out by way of transformation, transfection and the like. The term "host cell" is also intended to include progeny or potential progeny of a single cell. Because certain modifications may occur in succeeding generations due to either natural, accidental, or deliberate mutation or due to environmental influences, such progeny may not, in fact, be completely identical (in morphology or in genomic or total DNA complement) to the parent cell, but is still included within the scope of the term as used herein. Suitable host cells include prokaryotic or eukaryotic cells, and also include but are not limited to bacteria, yeast cells, fungi cells, plant cells, and animal cells such as insect cells and mammalian cells, e.g., murine, rat, macaque or human.

The antibody construct of the invention can be produced in bacteria. After expression, the antibody construct of the invention is isolated from the *E. coli* cell paste in a soluble fraction and can be purified through, e.g., affinity chromatography and/or size exclusion. Final purification can be carried out similar to the process for purifying antibody expressed e.g., in CHO cells.

In addition to prokaryotes, eukaryotic microbes such as filamentous fungi or yeast are suitable cloning or expression hosts for the antibody construct of the invention. *Saccharomyces cerevisiae*, or common baker's yeast, is the most commonly used among lower eukaryotic host microorganisms. However, a number of other genera, species, and strains are commonly available and useful herein, such as *Schizosaccharomyces pombe*, *Kluyveromyces* hosts such as *K. lactis*, *K. fragilis* (ATCC 12424), *K. bulgaricus* (ATCC 16045), *K. wickeramii* (ATCC 24178), *K. waltii* (ATCC 56500), *K. drosophilarum* (ATCC 36906), *K. thermotolerans*, and *K. marxianus*; *yarrowia* (EP 402 226); *Pichia pastoris* (EP 183 070); *Candida*; *Trichoderma reesia* (EP 244 234); *Neurospora crassa*; *Schwanniomyces* such as *Schwanniomyces occidentalis*; and filamentous fungi such as *Neurospora*, *Penicillium*, *Tolypocladium*, and *Aspergillus* hosts such as *A. nidulans* and *A. niger*.

Suitable host cells for the expression of glycosylated antibody construct of the invention are derived from multicellular organisms. Examples of invertebrate cells include plant and insect cells. Numerous baculoviral strains and variants and corresponding permissive insect host cells from hosts such as *Spodoptera frugiperda* (caterpillar), *Aedes aegypti* (mosquito), *Aedes albopictus* (mosquito), *Drosophila melanogaster* (fruit fly), and *Bombyx mori* have been identified. A variety of viral strains for transfection are publicly available, e.g., the L-1 variant of *Autographa californica* NPV and the Bm-5 strain of *Bombyx mori* NPV, and such viruses may be used as the virus herein according to the present invention, particularly for transfection of *Spodoptera frugiperda* cells.

Plant cell cultures of cotton, corn, potato, soybean, *petunia*, tomato, *Arabidopsis* and tobacco can also be used as hosts. Cloning and expression vectors useful in the production of proteins in plant cell culture are known to those of skill in the art. See e.g. Hiatt et al., Nature (1989) 342: 76-78, Owen et al. (1992) Bio/Technology 10: 790-794, Artsaenko et al. (1995) The Plant J 8: 745-750, and Fecker et al. (1996) Plant Mol Biol 32: 979-986.

However, interest has been greatest in vertebrate cells, and propagation of vertebrate cells in culture (tissue culture) has become a routine procedure. Examples of useful mammalian host cell lines are monkey kidney CV1 line transformed by SV40 (COS-7, ATCC CRL 1651); human embryonic kidney line (293 or 293 cells subcloned for growth in suspension culture, Graham et al., J. Gen Virol. 36:59 (1977)); baby hamster kidney cells (BHK, ATCC CCL 10); Chinese hamster ovary cells/–DHFR (CHO, Urlaub et al., Proc. Natl. Acad. Sci. USA 77: 4216 (1980)); mouse sertoli cells (TM4, Mather, Biol. Reprod. 23: 243-251 (1980)); monkey kidney cells (CVI ATCC CCL 70); African green monkey kidney cells (VERO-76, ATCC CRL1587); human cervical carcinoma cells (HELA, ATCC CCL 2); canine kidney cells (MDCK, ATCC CCL 34); buffalo rat liver cells (BRL 3A, ATCC CRL 1442); human lung cells (W138, ATCC CCL 75); human liver cells (Hep G2,1413 8065); mouse mammary tumor (MMT 060562, ATCC CCL5 1); TRI cells (Mather et al., Annals N. Y Acad. Sci. (1982) 383: 44-68); MRC 5 cells; FS4 cells; and a human hepatoma line (Hep G2).

In a further embodiment the invention provides a process for the production of an antibody construct of the invention, said process comprising culturing a host cell of the invention under conditions allowing the expression of the antibody construct of the invention and recovering the produced antibody construct from the culture.

As used herein, the term "culturing" refers to the in vitro maintenance, differentiation, growth, proliferation and/or propagation of cells under suitable conditions in a medium. The term "expression" includes any step involved in the production of an antibody construct of the invention including, but not limited to, transcription, post-transcriptional modification, translation, post-translational modification, and secretion.

When using recombinant techniques, the antibody construct can be produced intracellularly, in the periplasmic space, or directly secreted into the medium. If the antibody construct is produced intracellularly, as a first step, the particulate debris, either host cells or lysed fragments, are removed, for example, by centrifugation or ultrafiltration. Carter et al., Bio/Technology 10: 163-167 (1992) describe a procedure for isolating antibodies which are secreted to the periplasmic space of E. coli. Briefly, cell paste is thawed in the presence of sodium acetate (pH 3.5), EDTA, and phenylmethylsulfonylfluoride (PMSF) over about 30 min. Cell debris can be removed by centrifugation. Where the antibody is secreted into the medium, supernatants from such expression systems are generally first concentrated using a commercially available protein concentration filter, for example, an Amicon or Millipore Pellicon ultrafiltration unit. A protease inhibitor such as PMSF may be included in any of the foregoing steps to inhibit proteolysis and antibiotics may be included to prevent the growth of adventitious contaminants.

The antibody construct of the invention prepared from the host cells can be recovered or purified using, for example, hydroxylapatite chromatography, gel electrophoresis, dialysis, and affinity chromatography. Other techniques for protein purification such as fractionation on an ion-exchange column, ethanol precipitation, Reverse Phase HPLC, chromatography on silica, chromatography on heparin SEPHAROSE™, chromatography on an anion or cation exchange resin (such as a polyaspartic acid column), chromato-focusing, SDS-PAGE, and ammonium sulfate precipitation are also available depending on the antibody to be recovered. Where the antibody construct of the invention comprises a CH3 domain, the Bakerbond ABX resin (J.T. Baker, Phillipsburg, N.J.) is useful for purification.

Affinity chromatography is a preferred purification technique. The matrix to which the affinity ligand is attached is most often agarose, but other matrices are available. Mechanically stable matrices such as controlled pore glass or poly (styrenedivinyl) benzene allow for faster flow rates and shorter processing times than can be achieved with agarose.

Moreover, the invention provides a pharmaceutical composition comprising an antibody construct of the invention or an antibody construct produced according to the process of the invention.

As used herein, the term "pharmaceutical composition" relates to a composition which is suitable for administration to a patient, preferably a human patient. The particularly preferred pharmaceutical composition of this invention comprises one or a plurality of the antibody construct(s) of the invention, preferably in a therapeutically effective amount. Preferably, the pharmaceutical composition further comprises suitable formulations of one or more (pharmaceutically effective) carriers, stabilizers, excipients, diluents, solubilizers, surfactants, emulsifiers, preservatives and/or adjuvants. Acceptable constituents of the composition are preferably nontoxic to recipients at the dosages and concentrations employed. Pharmaceutical compositions of the invention include, but are not limited to, liquid, frozen, and lyophilized compositions.

The inventive compositions may comprise a pharmaceutically acceptable carrier. In general, as used herein, "pharmaceutically acceptable carrier" means any and all aqueous and non-aqueous solutions, sterile solutions, solvents, buffers, e.g. phosphate buffered saline (PBS) solutions, water, suspensions, emulsions, such as oil/water emulsions, various types of wetting agents, liposomes, dispersion media and coatings, which are compatible with pharmaceutical administration, in particular with parenteral administration. The use of such media and agents in pharmaceutical compositions is well known in the art, and the compositions comprising such carriers can be formulated by well-known conventional methods.

Certain embodiments provide pharmaceutical compositions comprising the antibody construct of the invention and further one or more excipients such as those illustratively described in this section and elsewhere herein. Excipients can be used in the invention in this regard for a wide variety of purposes, such as adjusting physical, chemical, or biological properties of formulations, such as adjustment of viscosity, and or processes of the invention to improve effectiveness and or to stabilize such formulations and processes against degradation and spoilage due to, for instance, stresses that occur during manufacturing, shipping, storage, pre-use preparation, administration, and thereafter. In certain embodiments, the pharmaceutical composition may contain formulation materials for the purpose of modifying, maintaining or preserving, e.g., the pH, osmolarity, viscosity, clarity, color, isotonicity, odor, sterility, stability, rate of dissolution or release, adsorption or penetration of the composition (see, REMINGTON'S PHARMACEUTICAL SCIENCES, 18" Edition, (A.R. Genrmo, ed.), 1990, Mack Publishing Company). In such embodiments, suitable formulation materials may include, but are not limited to:

amino acids such as glycine, alanine, glutamine, asparagine, threonine, proline, 2-phenylalanine, including charged amino acids, preferably lysine, lysine acetate, arginine, glutamate and/or histidine antimicrobials such as antibacterial and antifungal agents antioxidants such as ascorbic acid, methionine, sodium sulfite or sodium hydrogen-sulfite;

buffers, buffer systems and buffering agents which are used to maintain the composition at physiological pH or at a slightly lower pH, typically within a pH range of from about 5 to about 8 or 9; examples of buffers are borate, bicarbonate, Tris-HCl, citrates, phosphates or other organic acids, succinate, phosphate, histidine and acetate; for example Tris buffer of about pH 7.0-8.5, or acetate buffer of about pH 4.0-5.5;

non-aqueous solvents such as propylene glycol, polyethylene glycol, vegetable oils such as olive oil, and injectable organic esters such as ethyl oleate;

aqueous carriers including water, alcoholic/aqueous solutions, emulsions or suspensions, including saline and buffered media;

biodegradable polymers such as polyesters;

bulking agents such as mannitol or glycine;

chelating agents such as ethylenediamine tetraacetic acid (EDTA);

isotonic and absorption delaying agents;

complexing agents such as caffeine, polyvinylpyrrolidone, beta-cyclodextrin or hydroxypropyl-beta-cyclodextrin)

fillers;

monosaccharides; disaccharides; and other carbohydrates (such as glucose, mannose or dextrins); carbohydrates may be non-reducing sugars, preferably trehalose, sucrose, octasulfate, sorbitol or xylitol;

(low molecular weight) proteins, polypeptides or proteinaceous carriers such as human or bovine serum albumin, gelatin or immunoglobulins, preferably of human origin;

coloring and flavouring agents;

sulfur containing reducing agents, such as glutathione, thioctic acid, sodium thioglycolate, thioglycerol, [alpha]-monothioglycerol, and sodium thio sulfate diluting agents;

emulsifying agents;

hydrophilic polymers such as polyvinylpyrrolidone)

salt-forming counter-ions such as sodium;

preservatives such as antimicrobials, anti-oxidants, chelating agents, inert gases and the like; examples are: benzalkonium chloride, benzoic acid, salicylic acid, thimerosal, phenethyl alcohol, methylparaben, propylparaben, chlorhexidine, sorbic acid or hydrogen peroxide);

metal complexes such as Zn-protein complexes;

solvents and co-solvents (such as glycerin, propylene glycol or polyethylene glycol);

sugars and sugar alcohols, such as trehalose, sucrose, octasulfate, mannitol, sorbitol or xylitol stachyose, mannose, sorbose, xylose, ribose, myoinisitose, galactose, lactitol, ribitol, myoinisitol, galactitol, glycerol, cyclitols (e.g., inositol), polyethylene glycol; and polyhydric sugar alcohols;

suspending agents;

surfactants or wetting agents such as pluronics, PEG, sorbitan esters, polysorbates such as polysorbate 20, polysorbate, triton, tromethamine, lecithin, cholesterol, tyloxapal; surfactants may be detergents, preferably with a molecular weight of >1.2 KD and/or a polyether, preferably with a molecular weight of >3 KD; non-limiting examples for preferred detergents are Tween 20, Tween 40, Tween 60, Tween 80 and Tween 85; non-limiting examples for preferred polyethers are PEG 3000, PEG 3350, PEG 4000 and PEG 5000;

stability enhancing agents such as sucrose or sorbitol;

tonicity enhancing agents such as alkali metal halides, preferably sodium or potassium chloride, mannitol sorbitol;

parenteral delivery vehicles including sodium chloride solution, Ringer's dextrose, dextrose and sodium chloride, lactated Ringer's, or fixed oils;

intravenous delivery vehicles including fluid and nutrient replenishers, electrolyte replenishers (such as those based on Ringer's dextrose).

It is evident to those skilled in the art that the different constituents of the pharmaceutical composition (e.g., those listed above) can have different effects, for example, and amino acid can act as a buffer, a stabilizer and/or an antioxidant; mannitol can act as a bulking agent and/or a tonicity enhancing agent; sodium chloride can act as delivery vehicle and/or tonicity enhancing agent; etc.

It is envisaged that the composition of the invention might comprise, in addition to the polypeptide of the invention defined herein, further biologically active agents, depending on the intended use of the composition. Such agents might be drugs acting on the gastro-intestinal system, drugs acting as cytostatica, drugs preventing hyperurikemia, drugs inhibiting immunoreactions (e.g. corticosteroids), drugs modulating the inflammatory response, drugs acting on the circulatory system and/or agents such as cytokines known in the art. It is also envisaged that the antibody construct of the present invention is applied in a co-therapy, i.e., in combination with another anti-cancer medicament.

In certain embodiments, the optimal pharmaceutical composition will be determined by one skilled in the art depending upon, for example, the intended route of administration, delivery format and desired dosage. See, for example, REMINGTON'S PHARMACEUTICAL SCIENCES, supra. In certain embodiments, such compositions may influence the physical state, stability, rate of in vivo release and rate of in vivo clearance of the antibody construct of the invention. In certain embodiments, the primary vehicle or carrier in a pharmaceutical composition may be either aqueous or non-aqueous in nature. For example, a suitable vehicle or carrier may be water for injection, physiological saline solution or artificial cerebrospinal fluid, possibly supplemented with other materials common in compositions for parenteral administration. Neutral buffered saline or saline mixed with serum albumin are further exemplary vehicles. In certain embodiments, the antibody construct of the invention compositions may be prepared for storage by mixing the selected composition having the desired degree of purity with optional formulation agents (REMINGTON'S PHARMACEUTICAL SCIENCES, supra) in the form of a lyophilized cake or an aqueous solution. Further, in certain embodiments, the antibody construct of the invention may be formulated as a lyophilizate using appropriate excipients such as sucrose.

When parenteral administration is contemplated, the therapeutic compositions for use in this invention may be provided in the form of a pyrogen-free, parenterally acceptable aqueous solution comprising the desired antibody construct of the invention in a pharmaceutically acceptable vehicle. A particularly suitable vehicle for parenteral injection is sterile distilled water in which the antibody construct of the invention is formulated as a sterile, isotonic solution, properly preserved. In certain embodiments, the preparation can involve the formulation of the desired molecule with an agent, such as injectable microspheres, bio-erodible particles, polymeric compounds (such as polylactic acid or polyglycolic acid), beads or liposomes, that may provide controlled or sustained release of the product which can be delivered via depot injection. In certain embodiments, hyaluronic acid may also be used, having the effect of promoting sustained duration in the circulation. In certain embodiments, implantable drug delivery devices may be used to introduce the desired antibody construct.

Additional pharmaceutical compositions will be evident to those skilled in the art, including formulations involving the antibody construct of the invention in sustained- or controlled-delivery/release formulations. Techniques for formulating a variety of other sustained- or controlled-delivery means, such as liposome carriers, bio-erodible microparticles or porous beads and depot injections, are also known to those skilled in the art. See, for example, International Patent Application No. PCT/US93/00829, which describes controlled release of porous polymeric microparticles for delivery of pharmaceutical compositions. Sustained-release preparations may include semipermeable polymer matrices in the form of shaped articles, e.g., films, or microcapsules. Sustained release matrices may include polyesters, hydrogels, polylactides (as disclosed in U.S. Pat. No. 3,773,919 and European Patent Application Publication No. EP 058481), copolymers of L-glutamic acid and gamma ethyl-L-glutamate (Sidman et al., 1983, Biopolymers 2:547-

556), poly (2-hydroxyethyl-methacrylate) (Langer et al., 1981, J. Biomed. Mater. Res. 15:167-277 and Langer, 1982, Chem. Tech. 12:98-105), ethylene vinyl acetate (Langer et al., 1981, supra) or poly-D(−)-3-hydroxybutyric acid (European Patent Application Publication No. EP 133,988). Sustained release compositions may also include liposomes that can be prepared by any of several methods known in the art. See, e.g., Eppstein et al., 1985, Proc. Natl. Acad. Sci. U.S.A. 82:3688-3692; European Patent Application Publication Nos. EP 036,676; EP 088,046 and EP 143,949.

The antibody construct may also be entrapped in microcapsules prepared, for example, by coacervation techniques or by interfacial polymerization (for example, hydroxymethylcellulose or gelatine-microcapsules and poly (methylmethacylate) microcapsules, respectively), in colloidal drug delivery systems (for example, liposomes, albumin microspheres, microemulsions, nanoparticles and nanocapsules), or in macroemulsions. Such techniques are disclosed in Remington's Pharmaceutical Sciences, 16th edition, Oslo, A., Ed., (1980).

Pharmaceutical compositions used for in vivo administration are typically provided as sterile preparations. Sterilization can be accomplished by filtration through sterile filtration membranes. When the composition is lyophilized, sterilization using this method may be conducted either prior to or following lyophilization and reconstitution. Compositions for parenteral administration can be stored in lyophilized form or in a solution. Parenteral compositions generally are placed into a container having a sterile access port, for example, an intravenous solution bag or vial having a stopper pierceable by a hypodermic injection needle.

Another aspect of the invention includes self-buffering antibody construct of the invention formulations, which can be used as pharmaceutical compositions, as described in international patent application WO 06138181A2 (PCT/US2006/022599). A variety of expositions are available on protein stabilization and formulation materials and methods useful in this regard, such as Arakawa et al., "Solvent interactions in pharmaceutical formulations," Pharm Res. 8(3): 285-91 (1991); Kendrick et al., "Physical stabilization of proteins in aqueous solution" in: RATIONAL DESIGN OF STABLE PROTEIN FORMULATIONS: THEORY AND PRACTICE, Carpenter and Manning, eds. Pharmaceutical Biotechnology. 13: 61-84 (2002), and Randolph et al., "Surfactant-protein interactions", Pharm Biotechnol. 13: 159-75 (2002), see particularly the parts pertinent to excipients and processes of the same for self-buffering protein formulations in accordance with the current invention, especially as to protein pharmaceutical products and processes for veterinary and/or human medical uses.

Salts may be used in accordance with certain embodiments of the invention to, for example, adjust the ionic strength and/or the isotonicity of a formulation and/or to improve the solubility and/or physical stability of a protein or other ingredient of a composition in accordance with the invention. As is well known, ions can stabilize the native state of proteins by binding to charged residues on the protein's surface and by shielding charged and polar groups in the protein and reducing the strength of their electrostatic interactions, attractive, and repulsive interactions. Ions also can stabilize the denatured state of a protein by binding to, in particular, the denatured peptide linkages (—CONH) of the protein. Furthermore, ionic interaction with charged and polar groups in a protein also can reduce intermolecular electrostatic interactions and, thereby, prevent or reduce protein aggregation and insolubility.

Ionic species differ significantly in their effects on proteins. A number of categorical rankings of ions and their effects on proteins have been developed that can be used in formulating pharmaceutical compositions in accordance with the invention. One example is the Hofmeister series, which ranks ionic and polar non-ionic solutes by their effect on the conformational stability of proteins in solution. Stabilizing solutes are referred to as "kosmotropic". Destabilizing solutes are referred to as "chaotropic". Kosmotropes commonly are used at high concentrations (e.g., >1 molar ammonium sulfate) to precipitate proteins from solution ("salting-out"). Chaotropes commonly are used to denture and/or to solubilize proteins ("salting-in"). The relative effectiveness of ions to "salt-in" and "salt-out" defines their position in the Hofmeister series.

Free amino acids can be used in the antibody construct of the invention formulations in accordance with various embodiments of the invention as bulking agents, stabilizers, and antioxidants, as well as other standard uses. Lysine, proline, serine, and alanine can be used for stabilizing proteins in a formulation. Glycine is useful in lyophilization to ensure correct cake structure and properties. Arginine may be useful to inhibit protein aggregation, in both liquid and lyophilized formulations. Methionine is useful as an antioxidant.

Polyols include sugars, e.g., mannitol, sucrose, and sorbitol and polyhydric alcohols such as, for instance, glycerol and propylene glycol, and, for purposes of discussion herein, polyethylene glycol (PEG) and related substances. Polyols are kosmotropic. They are useful stabilizing agents in both liquid and lyophilized formulations to protect proteins from physical and chemical degradation processes. Polyols also are useful for adjusting the tonicity of formulations. Among polyols useful in select embodiments of the invention is mannitol, commonly used to ensure structural stability of the cake in lyophilized formulations. It ensures structural stability to the cake. It is generally used with a lyoprotectant, e.g., sucrose. Sorbitol and sucrose are among preferred agents for adjusting tonicity and as stabilizers to protect against freeze-thaw stresses during transport or the preparation of bulks during the manufacturing process. Reducing sugars (which contain free aldehyde or ketone groups), such as glucose and lactose, can glycate surface lysine and arginine residues. Therefore, they generally are not among preferred polyols for use in accordance with the invention. In addition, sugars that form such reactive species, such as sucrose, which is hydrolyzed to fructose and glucose under acidic conditions, and consequently engenders glycation, also is not among preferred polyols of the invention in this regard. PEG is useful to stabilize proteins and as a cryoprotectant and can be used in the invention in this regard.

Embodiments of the antibody construct of the invention formulations further comprise surfactants. Protein molecules may be susceptible to adsorption on surfaces and to denaturation and consequent aggregation at air-liquid, solid-liquid, and liquid-liquid interfaces. These effects generally scale inversely with protein concentration. These deleterious interactions generally scale inversely with protein concentration and typically are exacerbated by physical agitation, such as that generated during the shipping and handling of a product. Surfactants routinely are used to prevent, minimize, or reduce surface adsorption. Useful surfactants in the invention in this regard include polysorbate 20, polysorbate 80, other fatty acid esters of sorbitan polyethoxylates, and poloxamer 188. Surfactants also are commonly used to control protein conformational stability. The use of surfactants in this regard is protein-specific since, any given surfactant typically will stabilize some proteins and destabilize others.

Polysorbates are susceptible to oxidative degradation and often, as supplied, contain sufficient quantities of peroxides to cause oxidation of protein residue side-chains, especially methionine. Consequently, polysorbates should be used carefully, and when used, should be employed at their lowest effective concentration. In this regard, polysorbates exemplify the general rule that excipients should be used in their lowest effective concentrations.

Embodiments of the antibody construct of the invention formulations further comprise one or more antioxidants. To some extent deleterious oxidation of proteins can be prevented in pharmaceutical formulations by maintaining proper levels of ambient oxygen and temperature and by avoiding exposure to light. Antioxidant excipients can be used as well to prevent oxidative degradation of proteins. Among useful antioxidants in this regard are reducing agents, oxygen/free-radical scavengers, and chelating agents. Antioxidants for use in therapeutic protein formulations in accordance with the invention preferably are water-soluble and maintain their activity throughout the shelf life of a product. EDTA is a preferred antioxidant in accordance with the invention in this regard. Antioxidants can damage proteins. For instance, reducing agents, such as glutathione in particular, can disrupt intramolecular disulfide linkages. Thus, antioxidants for use in the invention are selected to, among other things, eliminate or sufficiently reduce the possibility of themselves damaging proteins in the formulation.

Formulations in accordance with the invention may include metal ions that are protein co-factors and that are necessary to form protein coordination complexes, such as zinc necessary to form certain insulin suspensions. Metal ions also can inhibit some processes that degrade proteins. However, metal ions also catalyze physical and chemical processes that degrade proteins. Magnesium ions (10-120 mM) can be used to inhibit isomerization of aspartic acid to isoaspartic acid. $Ca^{+2}$ ions (up to 100 mM) can increase the stability of human deoxyribonuclease. $Mg^{+2}$, $Mn^{+2}$, and $Zn^{+2}$, however, can destabilize rhDNase. Similarly, $Ca^{+2}$ and $Sr^{+2}$ can stabilize Factor VIII, it can be destabilized by $Mg^{+2}$, $Mn^{+2}$ and $Zn^{+2}$, $Cu^{+2}$ and $Fe^{+2}$, and its aggregation can be increased by $Al^{+3}$ ions.

Embodiments of the antibody construct of the invention formulations further comprise one or more preservatives. Preservatives are necessary when developing multi-dose parenteral formulations that involve more than one extraction from the same container. Their primary function is to inhibit microbial growth and ensure product sterility throughout the shelf-life or term of use of the drug product. Commonly used preservatives include benzyl alcohol, phenol and m-cresol. Although preservatives have a long history of use with small-molecule parenterals, the development of protein formulations that includes preservatives can be challenging. Preservatives almost always have a destabilizing effect (aggregation) on proteins, and this has become a major factor in limiting their use in multi-dose protein formulations. To date, most protein drugs have been formulated for single-use only. However, when multi-dose formulations are possible, they have the added advantage of enabling patient convenience, and increased marketability. A good example is that of human growth hormone (hGH) where the development of preserved formulations has led to commercialization of more convenient, multi-use injection pen presentations. At least four such pen devices containing preserved formulations of hGH are currently available on the market. Norditropin (liquid, Novo Nordisk), Nutropin AQ (liquid, Genentech) & Genotropin (lyophilized—dual chamber cartridge, Pharmacia & Upjohn) contain phenol while Somatrope (Eli Lilly) is formulated with m-cresol. Several aspects need to be considered during the formulation and development of preserved dosage forms. The effective preservative concentration in the drug product must be optimized. This requires testing a given preservative in the dosage form with concentration ranges that confer anti-microbial effectiveness without compromising protein stability.

As might be expected, development of liquid formulations containing preservatives are more challenging than lyophilized formulations. Freeze-dried products can be lyophilized without the preservative and reconstituted with a preservative containing diluent at the time of use. This shortens the time for which a preservative is in contact with the protein, significantly minimizing the associated stability risks. With liquid formulations, preservative effectiveness and stability should be maintained over the entire product shelf-life (about 18 to 24 months). An important point to note is that preservative effectiveness should be demonstrated in the final formulation containing the active drug and all excipient components.

The antibody constructs disclosed herein may also be formulated as immuno-liposomes. A "liposome" is a small vesicle composed of various types of lipids, phospholipids and/or surfactant which is useful for delivery of a drug to a mammal. The components of the liposome are commonly arranged in a bilayer formation, similar to the lipid arrangement of biological membranes. Liposomes containing the antibody construct are prepared by methods known in the art, such as described in Epstein et al., Proc. Natl. Acad. Sci. USA, 82: 3688 (1985); Hwang et al., Proc. Natl Acad. Sci. USA, 77: 4030 (1980); U.S. Pat. Nos. 4,485,045 and 4,544,545; and WO 97/38731. Liposomes with enhanced circulation time are disclosed in U.S. Pat. No. 5,013,556. Particularly useful liposomes can be generated by the reverse phase evaporation method with a lipid composition comprising phosphatidylcholine, cholesterol and PEG-derivatized phosphatidylethanolamine (PEG-PE). Liposomes are extruded through filters of defined pore size to yield liposomes with the desired diameter. Fab' fragments of the antibody construct of the present invention can be conjugated to the liposomes as described in Martin et al. J. Biol. Chem. 257: 286-288 (1982) via a disulfide interchange reaction. A chemotherapeutic agent is optionally contained within the liposome. See Gabizon et al. J. National Cancer Inst. 81 (19) 1484 (1989).

Once the pharmaceutical composition has been formulated, it may be stored in sterile vials as a solution, suspension, gel, emulsion, solid, crystal, or as a dehydrated or lyophilized powder. Such formulations may be stored either in a ready-to-use form or in a form (e.g., lyophilized) that is reconstituted prior to administration.

The biological activity of the pharmaceutical composition defined herein can be determined for instance by cytotoxicity assays, as described in the following examples, in WO 99/54440 or by Schlereth et al. (Cancer Immunol. Immunother. 20 (2005), 1-12). "Efficacy" or "in vivo efficacy" as used herein refers to the response to therapy by the pharmaceutical composition of the invention, using e.g. standardized NCI response criteria. The success or in vivo efficacy of the therapy using a pharmaceutical composition of the invention refers to the effectiveness of the composition for its intended purpose, i.e. the ability of the composition to cause its desired effect, i.e. depletion of pathologic cells, e.g. tumor cells. The in vivo efficacy may be monitored by established standard methods for the respective disease entities including, but not limited to white blood cell counts, differentials, Fluorescence Activated Cell Sorting, bone marrow aspiration. In addition, various disease specific clinical chemistry parameters and other established standard methods may be used. Furthermore, computer-aided tomography, X-ray, nuclear magnetic resonance tomography (e.g. for National Cancer Institute-criteria based response assessment [Cheson B D, Horning S J, Coiffier B, Shipp M A, Fisher R I, Connors J M, Lister T A, Vose J, Grillo-Lopez A, Hagenbeek A, Cabanillas F, Klippensten D, Hiddemann W, Castellino R, Harris N L, Armitage J O, Carter W, Hoppe R, Canellos G P. Report of an international workshop to standardize response criteria for non-Hodgkin's lymphomas. NCI Sponsored International Working Group. J Clin Oncol. 1999 April; 17(4):1244]), positron-emission tomography scanning, white blood cell counts, differentials, Fluorescence Activated Cell Sorting, bone marrow aspiration, lymph node biopsies/histologies, and various lymphoma specific clinical chemistry parameters (e.g. lactate dehydrogenase) and other established standard methods may be used.

Another major challenge in the development of drugs such as the pharmaceutical composition of the invention is the predictable modulation of pharmacokinetic properties. To this end, a pharmacokinetic profile of the drug candidate, i.e. a profile of the pharmacokinetic parameters that affect the ability of a particular drug to treat a given condition, can be established. Pharmacokinetic parameters of the drug influencing the ability of a drug for treating a certain disease entity include, but are not limited to: half-life, volume of distribution, hepatic first-pass metabolism and the degree of blood serum binding. The efficacy of a given drug agent can be influenced by each of the parameters mentioned above.

"Half-life" means the time where 50% of an administered drug are eliminated through biological processes, e.g. metabolism, excretion, etc. By "hepatic first-pass metabolism" is meant the propensity of a drug to be metabolized upon first contact with the liver, i.e. during its first pass through the liver. "Volume of distribution" means the degree of retention of a drug throughout the various compartments of the body, like e.g. intracellular and extracellular spaces, tissues and organs, etc. and the distribution of the drug within these compartments. "Degree of blood serum binding" means the propensity of a drug to interact with and bind to blood serum proteins, such as albumin, leading to a reduction or loss of biological activity of the drug.

Pharmacokinetic parameters also include bioavailability, lag time (Tlag), Tmax, absorption rates, more onset and/or Cmax for a given amount of drug administered. "Bioavailability" means the amount of a drug in the blood compartment. "Lag time" means the time delay between the administration of the drug and its detection and measurability in blood or plasma. "Tmax" is the time after which maximal blood concentration of the drug is reached, and "Cmax" is the blood concentration maximally obtained with a given drug. The time to reach a blood or tissue concentration of the drug which is required for its biological effect is influenced by all parameters. Pharmacokinetic parameters of bispecific antibody constructs exhibiting cross-species specificity, which may be determined in preclinical animal testing in non-chimpanzee primates as outlined above, are also set forth e.g. in the publication by Schlereth et al. (Cancer Immunol. Immunother. 20 (2005), 1-12).

One embodiment provides the antibody construct of the invention or the antibody construct produced according to the process of the invention for use in the prevention, treatment or amelioration of a tumor or cancer disease or of a metastatic cancer disease.

The formulations described herein are useful as pharmaceutical compositions in the treatment, amelioration and/or prevention of the pathological medical condition as described herein in a patient in need thereof. The term "treatment" refers to both therapeutic treatment and prophylactic or preventative measures. Treatment includes the application or administration of the formulation to the body, an isolated tissue, or cell from a patient who has a disease/disorder, a symptom of a disease/disorder, or a predisposition toward a disease/disorder, with the purpose to cure, heal, alleviate, relieve, alter, remedy, ameliorate, improve, or affect the disease, the symptom of the disease, or the predisposition toward the disease.

The term "amelioration" as used herein refers to any improvement of the disease state of a patient having a tumor or cancer or a metastatic cancer as specified herein below, by the administration of an antibody construct according to the invention to a subject in need thereof. Such an improvement may also be seen as a slowing or stopping of the p progression of the tumor or cancer or metastatic cancer of the patient. The term "prevention" as used herein means the avoidance of the occurrence or re-occurrence of a patient having a tumor or cancer or a metastatic cancer as specified herein below, by the administration of an antibody construct according to the invention to a subject in need thereof.

The term "disease" refers to any condition that would benefit from treatment with the antibody construct or the pharmaceutic composition described herein. This includes chronic and acute disorders or diseases including those pathological conditions that predispose the mammal to the disease in question.

A "neoplasm" is is an abnormal growth of tissue, usually but not always forming a mass. When also forming a mass, it is commonly referred to as a "tumor". Neoplasms or tumors can be benign, potentially malignant (pre-cancerous), or malignant. Malignant neoplasms are commonly called cancer. They usually invade and destroy the surrounding tissue and may form metastases, i.e., they spread to other parts, tissues or organs of the body. Hence, the term "metastatic cancer" encompasses metastases to other tissues or organs than the one of the original tumor. Lymphomas and leukemias are lymphoid neoplasms. For the purposes of the present invention, they are also encompassed by the terms "tumor" or "cancer".

In a preferred embodiment of the invention, the tumor or cancer disease is selected from the group including, but not limited to, (or consisting of) lung cancer, preferably SCLC, breast, cervical, colon, colorectal, endometrial, head and neck, liver, ovarian, pancreatic, prostate, skin, gastric, testis, thyroid, adrenal, renal, bladder, uterine, esophageal, urothelial and brain tumor or cancer, lymphoma, carcinoma, and sarcoma, and a metastatic cancer disease derived from any of the foregoing.

More specifically, the tumor or cancer disease can be selected from the group consisting of small cell lung cancer (SCLC), non-small cell lung cancer (NSCLC), glioma, glioblastoma, melanoma, neuroendocrine prostate cancer, neuroendocrine pancreatic cancer, hepatoblastoma, and hepatocellular carcinoma. The metastatic cancer disease can be derived from any of the foregoing.

The invention also provides a method for the treatment or amelioration of tumor or cancer disease or a metastatic cancer disease, comprising the step of administering to a subject in need thereof the antibody construct of the invention or the antibody construct produced according to the process of the invention.

The terms "subject in need" or those "in need of treatment" includes those already with the disorder, as well as those in which the disorder is to be prevented. The subject in need or "patient" includes human and other mammalian subjects that receive either prophylactic or therapeutic treatment.

The antibody construct of the invention will generally be designed for specific routes and methods of administration, for specific dosages and frequencies of administration, for specific treatments of specific diseases, with ranges of bio-availability and persistence, among other things. The materials of the composition are preferably formulated in concentrations that are acceptable for the site of administration.

Formulations and compositions thus may be designed in accordance with the invention for delivery by any suitable route of administration. In the context of the present invention, the routes of administration include, but are not limited to topical routes (such as epicutaneous, inhalational, nasal, opthalmic, auricular/aural, vaginal, mucosal);

enteral routes (such as oral, gastrointestinal, sublingual, sublabial, buccal, rectal); and parenteral routes (such as intravenous, intraarterial, intraosseous, intramuscular, intracerebral, intracerebroventricular, epidural, intrathecal, subcutaneous, intraperitoneal, extra-amniotic, intraarticular, intracardiac, intradermal, intralesional, intrauterine, intravesical, intravitreal, transdermal, intranasal, transmucosal, intrasynovial, intraluminal).

The pharmaceutical compositions and the antibody construct of this invention are particularly useful for parenteral administration, e.g., subcutaneous or intravenous delivery, for example by injection such as bolus injection, or by infusion such as continuous infusion. Pharmaceutical compositions may be administered using a medical device. Examples of medical devices for administering pharmaceutical compositions are described in U.S. Pat. Nos. 4,475,196; 4,439,196; 4,447,224; 4,447, 233; 4,486,194; 4,487,603; 4,596,556; 4,790,824; 4,941,880; 5,064,413; 5,312,335; 5,312,335; 5,383,851; and 5,399,163.

In particular, the present invention provides for an uninterrupted administration of the suitable composition. As a non-limiting example, uninterrupted or substantially uninterrupted, i.e. continuous administration may be realized by a small pump system worn by the patient for metering the influx of therapeutic agent into the body of the patient. The pharmaceutical composition comprising the antibody construct of the invention can be administered by using said pump systems. Such pump systems are generally known in the art, and commonly rely on periodic exchange of cartridges containing the therapeutic agent to be infused. When exchanging the cartridge in such a pump system, a temporary interruption of the otherwise uninterrupted flow of therapeutic agent into the body of the patient may ensue. In such a case, the phase of administration prior to cartridge replacement and the phase of administration following cartridge replacement would still be considered within the meaning of the pharmaceutical means and methods of the invention together make up one "uninterrupted administration" of such therapeutic agent.

The continuous or uninterrupted administration of the antibody constructs of the invention may be intravenous or subcutaneous by way of a fluid delivery device or small pump system including a fluid driving mechanism for driving fluid out of a reservoir and an actuating mechanism for actuating the driving mechanism. Pump systems for subcutaneous administration may include a needle or a cannula for penetrating the skin of a patient and delivering the suitable composition into the patient's body. Said pump systems may be directly fixed or attached to the skin of the patient independently of a vein, artery or blood vessel, thereby allowing a direct contact between the pump system and the skin of the patient. The pump system can be attached to the skin of the patient for 24 hours up to several days. The pump system may be of small size with a reservoir for small volumes. As a non-limiting example, the volume of the reservoir for the suitable pharmaceutical composition to be administered can be between 0.1 and 50 ml.

The continuous administration may also be transdermal by way of a patch worn on the skin and replaced at intervals. One of skill in the art is aware of patch systems for drug delivery suitable for this purpose. It is of note that transdermal administration is especially amenable to uninterrupted administration, as exchange of a first exhausted patch can advantageously be accomplished simultaneously with the placement of a new, second patch, for example on the surface of the skin immediately adjacent to the first exhausted patch and immediately prior to removal of the first exhausted patch. Issues of flow interruption or power cell failure do not arise.

If the pharmaceutical composition has been lyophilized, the lyophilized material is first reconstituted in an appropriate liquid prior to administration. The lyophilized material may be reconstituted in, e.g., bacteriostatic water for injection (BWFI), physiological saline, phosphate buffered saline (PBS), or the same formulation the protein had been in prior to lyophilization.

The compositions of the present invention can be administered to the subject at a suitable dose which can be determined e.g. by dose escalating studies by administration of increasing doses of the antibody construct of the invention exhibiting cross-species specificity described herein to non-chimpanzee primates, for instance macaques. As set forth above, the antibody construct of the invention exhibiting cross-species specificity described herein can be advantageously used in identical form in preclinical testing in non-chimpanzee primates and as drug in humans. The dosage regimen will be determined by the attending physician and clinical factors. As is well known in the medical arts, dosages for any one patient depend upon many factors, including the patient's size, body surface area, age, the particular compound to be administered, sex, time and route of administration, general health, and other drugs being administered concurrently.

The term "effective dose" or "effective dosage" is defined as an amount sufficient to achieve or at least partially achieve the desired effect. The term "therapeutically effective dose" is defined as an amount sufficient to cure or at least partially arrest the disease and its complications in a patient already suffering from the disease. Amounts or doses effective for this use will depend on the condition to be treated (the indication), the delivered antibody construct, the therapeutic context and objectives, the severity of the disease, prior therapy, the patient's clinical history and response to the therapeutic agent, the route of administration, the size (body weight, body surface or organ size) and/or condition (the age and general health) of the patient, and the general state of the patient's own immune system. The proper dose can be adjusted according to the judgment of the attending physician such that it can be administered to the patient once or over a series of administrations, and in order to obtain the optimal therapeutic effect.

A typical dosage may range from about 0.1 µg/kg to up to about 30 mg/kg or more, depending on the factors mentioned above. In specific embodiments, the dosage may range from 1.0 µg/kg up to about 20 mg/kg, optionally from 10 µg/kg up to about 10 mg/kg or from 100 µg/kg up to about 5 mg/kg.

A therapeutic effective amount of an antibody construct of the invention preferably results in a decrease in severity of disease symptoms, an increase in frequency or duration of disease symptom-free periods or a prevention of impairment or disability due to the disease affliction. For treating DLL3-expressing tumors, a therapeutically effective amount of the antibody construct of the invention, e.g. an anti-DLL3/anti-CD3 antibody construct, preferably inhibits cell growth or tumor growth by at least about 20%, at least about 40%, at least about 50%, at least about 60%, at least about 70%, at least about 80%, or at least about 90% relative to untreated patients. The ability of a compound to inhibit tumor growth may be evaluated in an animal model predictive of efficacy in human tumors.

The pharmaceutical composition can be administered as a sole therapeutic or in combination with additional therapies such as anti-cancer therapies as needed, e.g. other proteinaceous and non-proteinaceous drugs. These drugs may be administered simultaneously with the composition comprising the antibody construct of the invention as defined herein or separately before or after administration of said antibody construct in timely defined intervals and doses.

The term "effective and non-toxic dose" as used herein refers to a tolerable dose of an inventive antibody construct which is high enough to cause depletion of pathologic cells, tumor elimination, tumor shrinkage or stabilization of disease without or essentially without major toxic effects. Such effective and non-toxic doses may be determined e.g. by dose escalation studies described in the art and should be below the dose inducing severe adverse side events (dose limiting toxicity, DLT).

The term "toxicity" as used herein refers to the toxic effects of a drug manifested in adverse events or severe adverse events. These side events might refer to a lack of tolerability of the drug in general and/or a lack of local tolerance after administration. Toxicity could also include teratogenic or carcinogenic effects caused by the drug.

The term "safety", "in vivo safety" or "tolerability" as used herein defines the administration of a drug without inducing severe adverse events directly after administration (local tolerance) and during a longer period of application of the drug. "Safety", "in vivo safety" or "tolerability" can be evaluated e.g. at regular intervals during the treatment and follow-up period. Measurements include clinical evaluation, e.g. organ manifestations, and screening of laboratory abnormalities. Clinical evaluation may be carried out and deviations to normal findings recorded/coded according to NCI-CTC and/or MedDRA standards. Organ manifestations may include criteria such as allergy/immunology, blood/bone marrow, cardiac arrhythmia, coagulation and the like, as set forth e.g. in the Common Terminology Criteria for adverse events v3.0 (CTCAE). Laboratory parameters which may be tested include for instance hematology, clinical chemistry, coagulation profile and urine analysis and examination of other body fluids such as serum, plasma, lymphoid or spinal fluid, liquor and the like. Safety can thus be assessed e.g. by physical examination, imaging techniques (i.e. ultrasound, x-ray, CT scans, Magnetic Resonance Imaging (MRI), other measures with technical devices (i.e. electrocardiogram), vital signs, by measuring laboratory parameters and recording adverse events. For example, adverse events in non-chimpanzee primates in the uses and methods according to the invention may be examined by histopathological and/or histochemical methods.

The above terms are also referred to e.g. in the Preclinical safety evaluation of biotechnology-derived pharmaceuticals S6; ICH Harmonised Tripartite Guideline; ICH Steering Committee meeting on Jul. 16, 1997.

In a further embodiment, the invention provides a kit comprising an antibody construct of the invention, an antibody construct produced according to the process of the invention, a polypeptide of the invention, a vector of the invention, and/or a host cell of the invention.

In the context of the present invention, the term "kit" means two or more components—one of which corresponding to the antibody construct, the pharmaceutical composition, the vector or the host cell of the invention—packaged together in a container, recipient or otherwise. A kit can hence be described as a set of products and/or utensils that are sufficient to achieve a certain goal, which can be marketed as a single unit.

The kit may comprise one or more recipients (such as vials, ampoules, containers, syringes, bottles, bags) of any appropriate shape, size and material (preferably waterproof, e.g. plastic or glass) containing the antibody construct or the pharmaceutical composition of the present invention in an appropriate dosage for administration (see above). The kit may additionally contain directions for use (e.g. in the form of a leaflet or instruction manual), means for administering the antibody construct of the present invention such as a syringe, pump, infuser or the like, means for reconstituting the antibody construct of the invention and/or means for diluting the antibody construct of the invention.

The invention also provides kits for a single-dose administration unit. The kit of the invention may also contain a first recipient comprising a dried/lyophilized antibody construct and a second recipient comprising an aqueous formulation. In certain embodiments of this invention, kits containing single-chambered and multi-chambered pre-filled syringes (e.g., liquid syringes and lyosyringes) are provided.

The Figures show:

FIG. 1

Schematic representation of the DLL3 ECD/truncated DLL3 constructs expressed on CHO cells for epitope mapping. The transmembrane and the intracellular domain are derived from EpCAM. See Example 1.

Figure 2A:
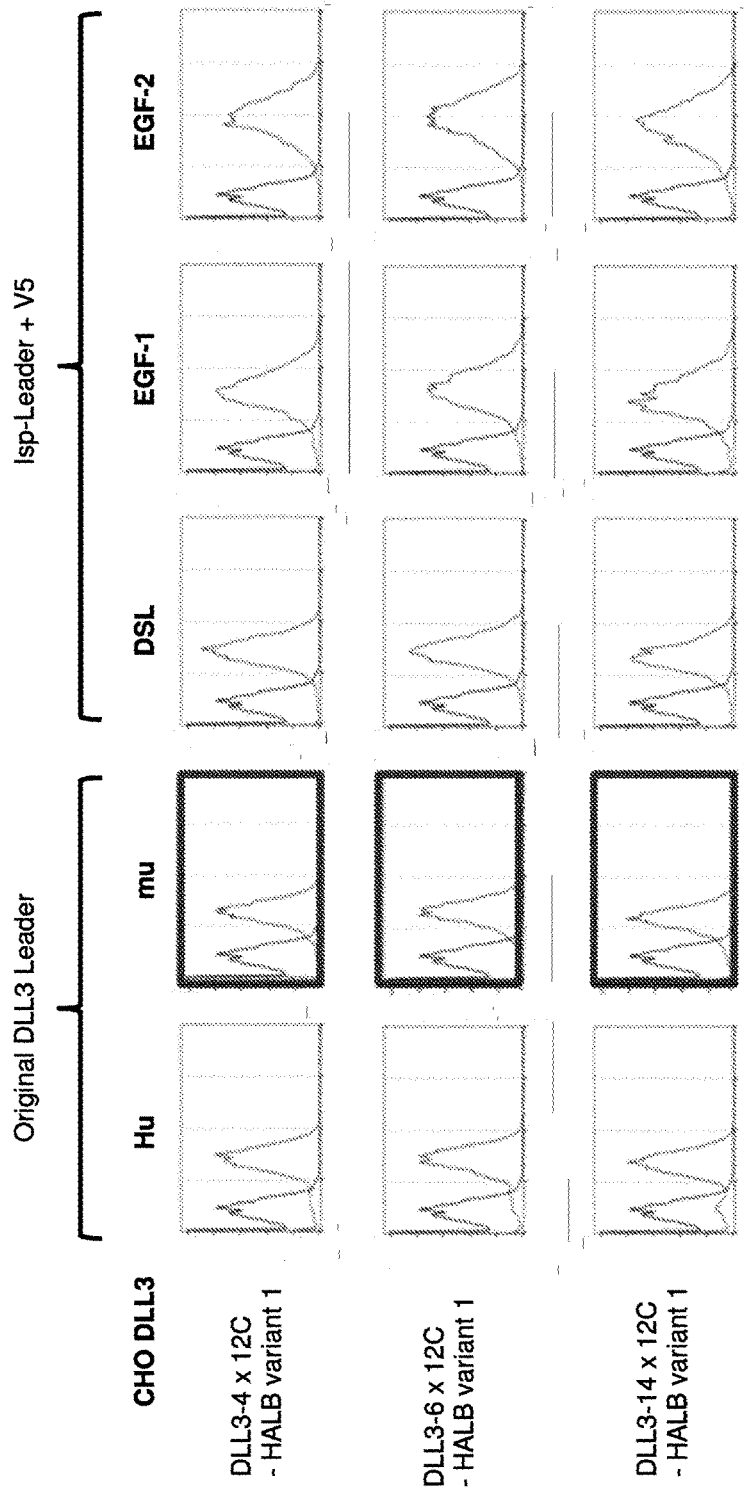

FIGS. 2A and 2B

Epitope mapping of the anti-DLL3 antibody constructs. Examples of bispecific antibody constructs recognizing the EGF-3 domain and the EGF-4 domain, respectively, as detected by epitope mapping. The x-axis depicts PE-A (PE=phycoerythrin, A=signal area), and the y-axis depicts counts. See Example 2.

FIGS. 3A-3C

Cross-Reactivity of anti-DLL3 antibody constructs as detected by flow cytometry: binding to human and macaque DLL3 and CD3. The x-axis depicts FL2-H, and the y-axis depicts counts. See Example 5.

FIG. 4

Analysis of anti-DLL3 antibody constructs by flow cytometry: non-binding to human paralogues DLL1 and DLL4. The x-axis depicts FL1-H, and the y-axis depicts counts. See Example 6.

FIG. 5

Stability of anti-DLL3 antibody constructs after incubation for 96 hours in human plasma. See Example 11.

FIG. 6

Potency gap between the monomeric and the dimeric isoform of the anti-DLL3 antibody constructs. See Example 15.

FIG. 7

In vitro internalization assay, carried out as described in Example 16. Antibody construct was pre-incubated on target cells (SHP-77) in the absence of T cells in order to measure loss of antibody construct due to internalization. Results suggest that no significant internalization occurs. The results achieved with a control target which is well known for its internalization are shown for comparison at the right.

Figure 8A:
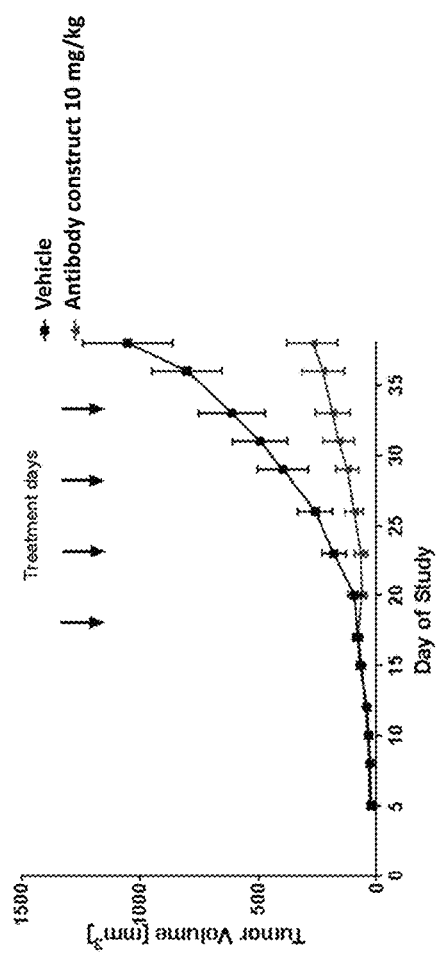
Figure 8B:
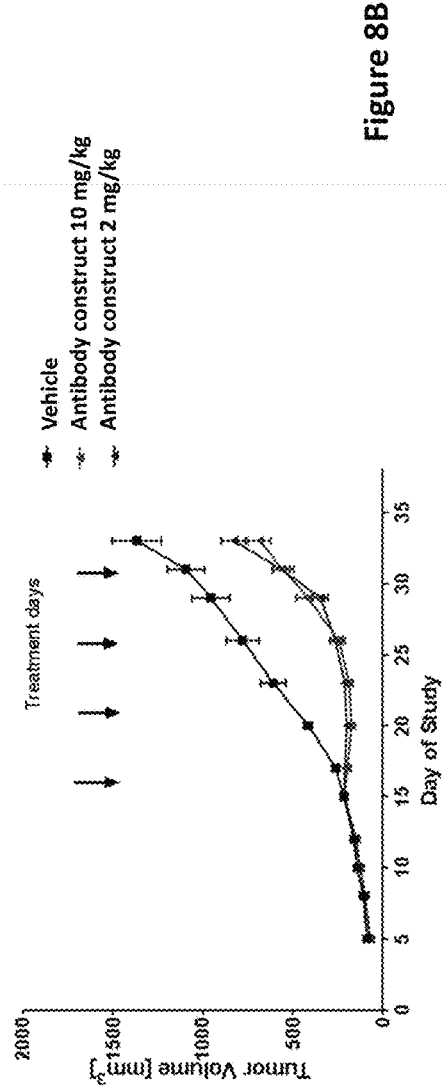

FIGS. 8A and 8B

Results of the mouse xenograft efficacy study of the SHP-77 model (FIG. 8A) and the WM266-4 model (FIG. 8B). The tumor volume is plotted against the time. See Example 18.

Figures 9A, 9B:
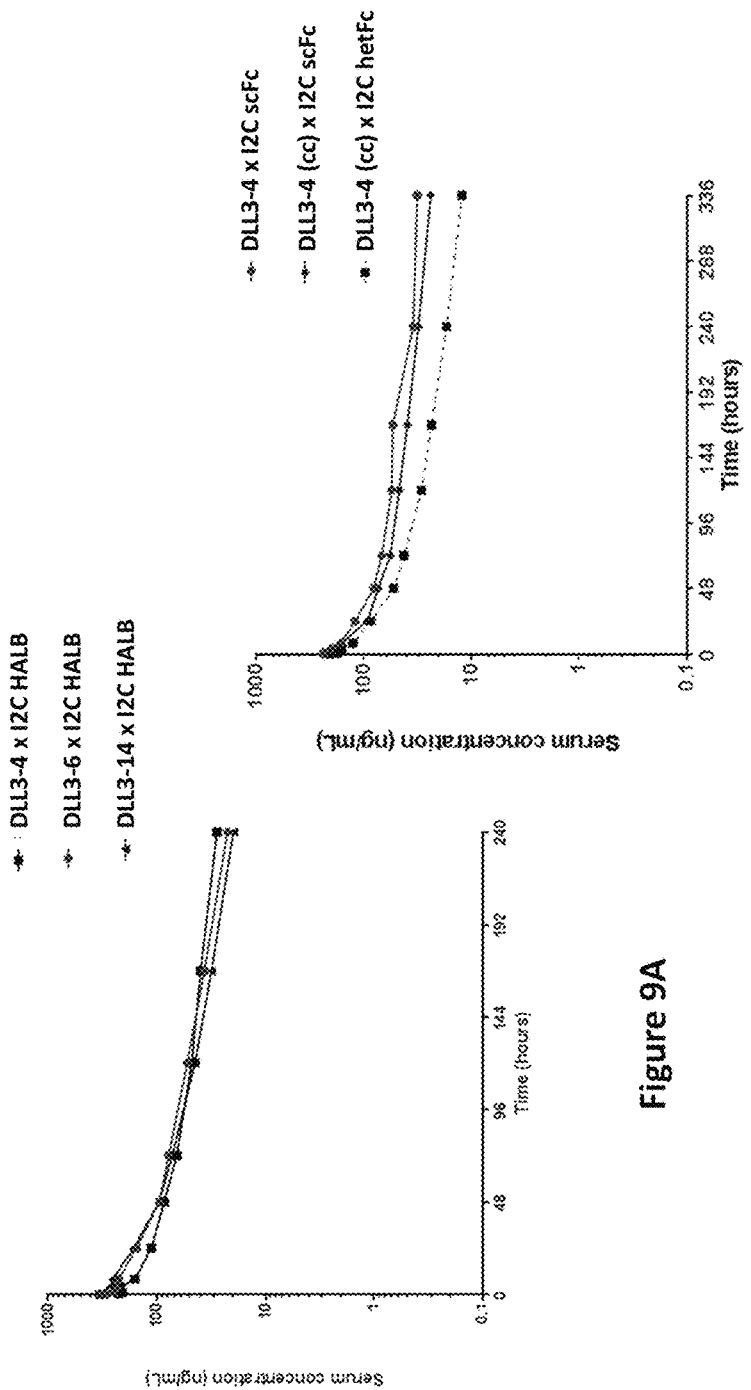

FIGS. 9A and 9B

Pharmacokinetics of different HLE antibody constructs (albumin fusion in FIG. 9A and Fc fusions in FIG. 9B) as determined in Example 20.

EXAMPLES

The following examples illustrate the invention. These examples should not be construed as to limit the scope of this invention. The present invention is limited only by the claims.

Example 1

Generation of CHO Cells Expressing Wild Type and Truncated DLL3

The extracellular domain of the DLL3 antigen can be subdivided into different sub-domains or regions that are defined, for the purposes of Examples 1 and 2, by the following amino acid positions:

Signal peptide: 1-26
N-terminus: 27-175
DSL: 176-215
EGF-1: 216-249
EGF-2: 274-310
EGF-3: 312-351
EGF-4: 353-389
EGF-5: 391-427
EGF-6: 429-465

For the construction of the truncated DLL3 molecules used for epitope mapping, the sequences of the respective eight extracellular domains (Signal peptide plus N-terminus, DSL, EGF1, EGF2, EGF3, EGF4, EGF5 and EGF6) of human DLL3 were stepwise deleted from the antigen, starting from the N-terminus. The following molecules were generated; see also FIG. 1:

| Hu DLL3 ECD/complete ECD | SEQ ID NO: 263 |
| Hu DLL3 ECD/up to DSL    | SEQ ID NO: 264 |
| Hu DLL3 ECD/up to EGF-1  | SEQ ID NO: 265 |
| Hu DLL3 ECD/up to EGF-2  | SEQ ID NO: 266 |
| Hu DLL3 ECD/up to EGF-3  | SEQ ID NO: 267 |
| Hu DLL3 ECD/up to EGF-4  | SEQ ID NO: 268 |
| Hu DLL3 ECD/up to EGF-5  | SEQ ID NO: 269 |
| Hu DLL3 ECD/only EGF-6   | SEQ ID NO: 270 |

For the generation of CHO cells expressing human, cynomolgus macaque ("cyno") and truncated human N-terminal V5 tagged DLL3, the respective coding sequences for human DLL3-ECD (SEQ ID NO: 253; see also GeneBank accession number NM_016941), cyno DLL3-ECD (SEQ ID NO: 272) and the seven truncated human N-terminal V5 tagged DLL3-ECD versions (see above) were cloned into a plasmid designated pEF-DHFR (pEF-DHFR is described in Raum et al. Cancer Immunol Immunother 50 (2001) 141-150). For cell surface expression of human and cyno DLL3 the original signal peptide was used, and for cell surface expression of the truncated human N-terminal DLL3 a mouse IgG heavy chain signal peptide was used, followed by a V5 tag. All mentioned DLL3-ECD sequences were followed in frame by the coding sequence of an artificial Ser/Gly-linker followed by a domain derived from the transmembrane/intracellular domain of human EpCAM (amino acids 266-314 of the sequence as published in GenBank accession number NM_002354). All cloning procedures were carried out according to standard protocols (Sambrook, Molecular Cloning; A Laboratory Manual, 3rd edition, Cold Spring Harbour Laboratory Press, Cold Spring Harbour, N.Y. (2001)). For each construct, a corresponding plasmid was transfected into DHFR deficient CHO cells for eukaryotic expression, as described by Kaufman R. J. (1990) Methods Enzymol. 185, 537-566.

The expression of human and cyno DLL3 on CHO cells was verified in a FACS assay using a monoclonal mouse IgG2b anti-human DLL3 antibody. The expression of the seven truncated versions of human DLL3-ECD was verified using a monoclonal mouse IgG2a anti-v5 tag antibody. Bound monoclonal antibody was detected with an anti-mouse IgG Fc-gamma-PE. As negative control, cells were incubated with isotype control antibody instead of the first antibody. The samples were measured by flow cytometry.

Example 2

Epitope Mapping of Anti-DLL3 Antibody Constructs

Cells transfected with human DLL3 and with the truncated human DLL3 molecules (see Example 1) were stained with crude, undiluted periplasmic extract containing bispecific DLL3×CD3 antibody constructs (with the CD3 binding domain being denominated I2C) fused to a human albumin (variant 1), in PBS/1.5% FCS. Bound molecules were detected with an in-house mouse monoclonal anti-CD3 binding domain antibody (50 µl) followed by an anti-mouse IgG Fc-gamma-PE (1:100, 50 µl; Jackson Immunoresearch #115-116-071) All antibodies were diluted in PBS/1.5% FCS. As negative control, cells were incubated with PBS/2% FCS instead of the periplasmic extract. The samples were measured by flow cytometry.

The regions that were recognized by the respective DLL3 binding domains are indicated in the sequence table (Table 18). Binders were mapped that were specific for an epitope located within the N-terminus of DLL3, within the DSL domain, and within the different EGF domains.

FIGS. 2A and 2B shows two exemplary binders which bind to a DLL3 epitope comprised within the EGF-3 region (loss of the FACS signal in the respective truncated DLL3 constructs not comprising EGF-3). FIGS. 2A and 2B also shows an exemplary binder which binds to a DLL3 epitope comprised within the EGF-3 region (loss of the FACS signal in the respective truncated DLL3 constructs not comprising EGF-4).

Some of the binders are described to be specific for an epitope located with the region denominated EGF-5/[6]. The squared brackets are meant to indicate that the FACS signal of the binder is decreased (i.e., neither fully present nor fully lost) for the truncated DLL3 construct having only the EGF-6 domain left (last construct in FIG. 1).

The bispecific DLL3×CD3 constructs used in the following examples are chosen from those constructs having "I2C" as the CD3 binding domain and having a C-terminal fusion to a wild-type human serum albumin, see e.g. SEQ ID NOs: 224-230, 233-235, 238-241.

Example 3

Biacore-Based Determination of Antibody Affinity to Human and Cynomolgus DLL3

Biacore analysis experiments were performed using recombinant human/cyno DLL3-ECD fusion proteins with chicken albumin to determine target binding of the antibody constructs of the invention.

In detail, CM5 Sensor Chips (GE Healthcare) were immobilized with approximately 600-800 RU of the respective recombinant antigen using acetate buffer pH 4.5 according to the manufacturer's manual. The DLL3×CD3 bispecific antibody construct samples were loaded in a dilution series of the following concentrations: 50 nM, 25 nM, 12.5 nM, 6.25 nM and 3.13 nM diluted in HBS-EP running buffer (GE Healthcare). Flow rate was 30 µl/min for 3 min, then HBS-EP running buffer was applied for 8 min to 20 min again at a flow rate of 30 µl/ml. Regeneration of the chip was performed using 10 mM glycine 10 mM NaCl pH 1.5 solution. Data sets were analyzed using BiaEval Software. In general two independent experiments were performed.

The DLL3×CD3 bispecific antibody constructs according to the invention showed very high affinities to human DLL3 in the subnanomolar range (with the exception of DLL3-13 having a KD value in the very low one-digit nanomolar range). Binding to macaque DLL3 was balanced, also showing affinities in similar ranges. The affinity values as well as the calculated affinity gap are shown in Table 2.

TABLE 2

Affinities of DLL3xCD3 bispecific antibody constructs to human and macaque DLL3 as determined by Biacore analysis, as well as the calculated interspecies affinity gaps.

| DLL3xCD3 bispecific antibody construct | KD hu DLL3 [nM] | KD cyno DLL3 [nM] | Affinity gap KD mac/KD hu |
|---|---|---|---|
| DLL3-4 | 0.41 | 0.55 | 1.34 |
| DLL3-5 | 0.82 | 1.03 | 1.26 |
| DLL3-6 | 0.55 | 0.75 | 1.36 |
| DLL3-7 | 0.19 | 0.29 | 1.52 |
| DLL3-8 | 0.69 | 0.96 | 1.39 |
| DLL3-9 | 0.35 | 0.54 | 1.54 |
| DLL3-10 | 0.24 | 0.33 | 1.38 |
| DLL3-13 | 1.74 | 5.55 | 3.19 |
| DLL3-14 | 0.47 | 0.86 | 1.83 |
| DLL3-15 | 0.45 | 0.69 | 1.53 |

Furthermore, the binding of the bispecific antibody constructs to both human CD3 and macaque CD3 was confirmed in a Biacore assay to be in a low 2-digit nanomolar range (data not shown).

Example 4

Scatchard-Based Analysis of DLL3×CD3 Bispecific Antibody Construct Affinity to Human and Macaque DLL3 on Target Antigen Positive Cells and Determination of the Interspecies Affinity Gap The affinities of DLL3×CD3 bispecific antibody constructs to CHO cells transfected with human or macaque DLL3 were also determined by Scatchard analysis as the most reliable method for measuring potential affinity gaps between human and macaque DLL3. For the Scatchard analysis, saturation binding experiments are performed using a monovalent detection system to precisely determine monovalent binding of the DLL3×CD3 bispecific antibody constructs to the respective cell line.

$2 \times 10^4$ cells of the respective cell line (recombinantly human DLL3-expressing CHO cell line, recombinantly macaque DLL3-expressing CHO cell line) were incubated each with 50 µl of a triplet dilution series (twelve dilutions at 1:2) of the respective DLL3×CD3 bispecific antibody construct (until saturation is reached) starting at 10-20 nM followed by 16 h incubation at 4° C. under agitation and one residual washing step. Then, the cells were incubated for another hour with 30 µl of a CD3×ALEXA488 conjugate solution. After one washing step, the cells were resuspended in 150 µl FACS buffer containing 3.5% formaldehyde, incubated for further 15 min, centrifuged, resuspended in FACS buffer and analyzed using a FACS Cantoll machine and FACS Diva software. Data were generated from two independent sets of experiments, each using triplicates. Respective Scatchard analysis was calculated to extrapolate maximal binding (Bmax). The concentrations of DLL3× CD3 bispecific antibody constructs at half-maximal binding were determined reflecting the respective KDs. Values of triplicate measurements were plotted as hyperbolic curves and as S-shaped curves to demonstrate proper concentration ranges from minimal to optimal binding.

Values depicted in Table 3 were derived from two independent experiments per DLL3×CD3 bispecific antibody construct. Cell based Scatchard analysis confirmed that the DLL3×CD3 bispecific antibody constructs of the invention are subnanomolar in affinity to human DLL3 and to mac DLL3 and present with a small cyno/human interspecies affinity gap of around 1.

TABLE 3

Affinities (KD) of DLL3xCD3 bispecific antibody constructs as determined in cell based Scatchard analysis with the calculated affinity gap KD macaque DLL3/KD human DLL3. Antibody constructs were measured in two independent experiments, each using triplicates.

| DLL3xCD3 bispecific antibody construct | Cell based affinity hu DLL3 [nM] | Cell based affinity mac DLL3 [nM] | Affinity gap KD mac/KD hu |
|---|---|---|---|
| DLL3-4 | 0.39 | 0.24 | 0.6 |
| DLL3-5 | 0.33 | 0.22 | 0.7 |
| DLL3-6 | 0.33 | 0.23 | 0.7 |
| DLL3-7 | 0.21 | 0.33 | 1.6 |
| DLL3-8 | 0.18 | 0.34 | 1.9 |
| DLL3-9 | 0.30 | 0.49 | 1.6 |
| DLL3-10 | 0.37 | 0.32 | 0.8 |
| DLL3-13 | 0.24 | 0.29 | 1.2 |
| DLL3-14 | 0.53 | 0.51 | 1.0 |
| DLL3-15 | 0.25 | 0.50 | 2.0 |

Example 5

Bispecific Binding and Interspecies Cross-Reactivity

For confirmation of binding to human DLL3 and CD3 and to cyno DLL3 and CD3, bispecific antibody constructs of the invention were tested by flow cytometry using CHO cells transfected with human DLL3, with an artificial human DLL3 isoform (characterized by the point mutations F172C and L218P), and with macaque DLL3, respectively, the human DLL3 positive human lung carcinoma cell line SHP-77, CD3-expressing human T cell leukemia cell line HPB-all (DSMZ, Braunschweig, ACC483), and the cynomolgus CD3-expressing T cell line LnPx 4119

For flow cytometry 200,000 cells of the respective cell lines were incubated for 60 min at 4° C. with 50 µl of purified bispecific antibody construct at a concentration of 5 µg/ml. The cells were washed twice in PBS/2% FCS and then incubated with an in-house mouse antibody (2 µg/ml) specific for the CD3 binding part of the bispecific antibody constructs for 30 min at 4° C. After washing, bound mouse antibodies were detected with a goat anti-mouse Fcγ-PE (1:100) for 30 min at 4° C. Samples were measured by flow cytometry. Non-transfected CHO cells were used as negative control.

Figure 3A:
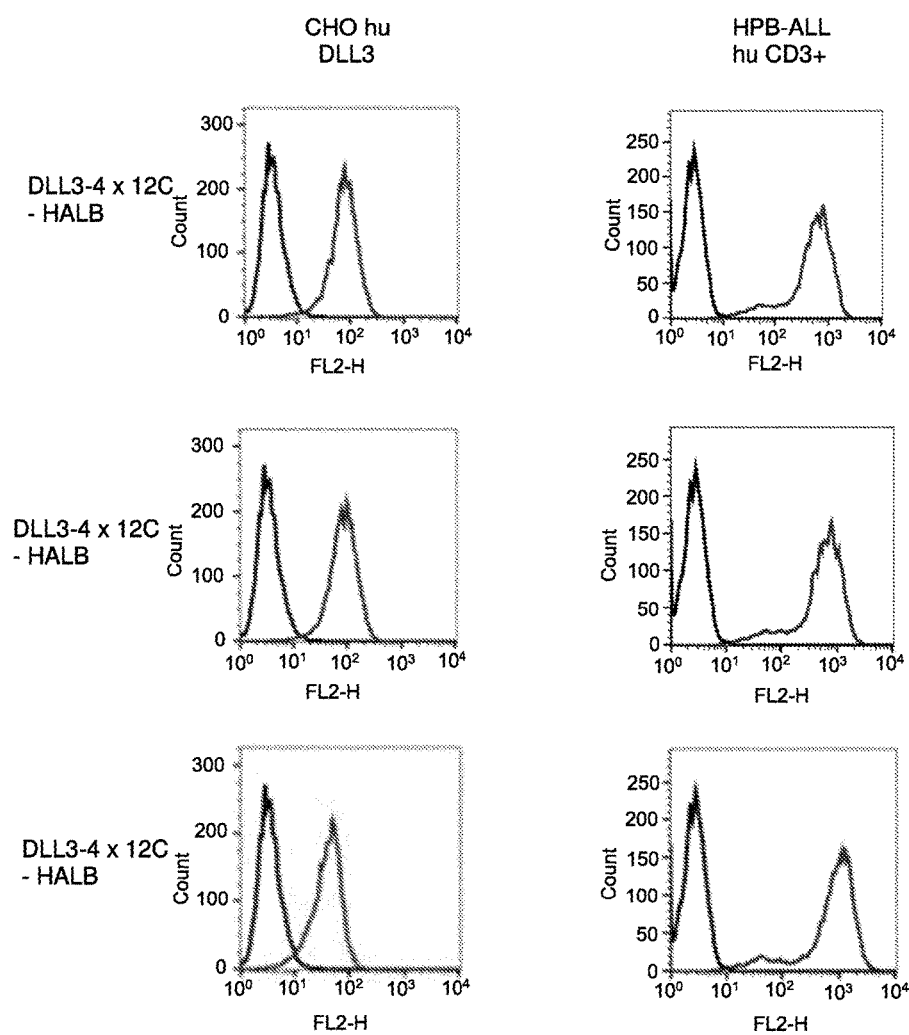
Figure 3B:
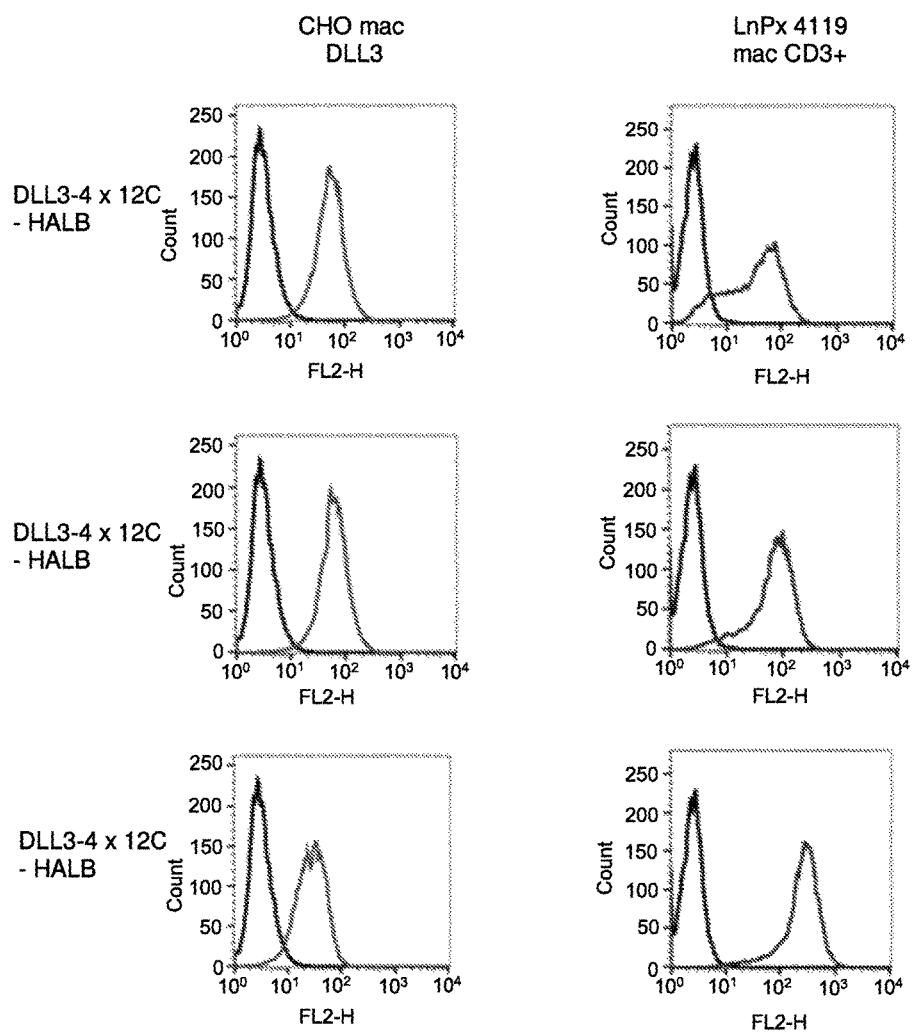
Figure 3C:
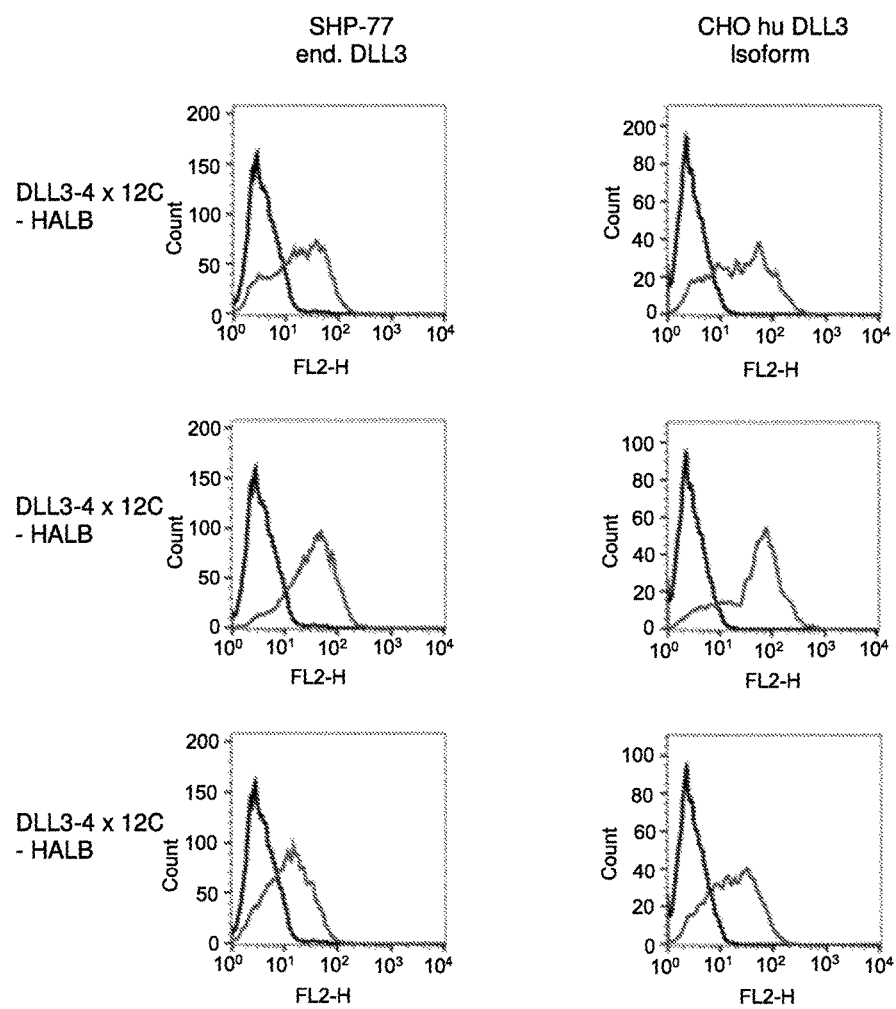

The results are shown in FIGS. 3A-3C. The DLL3×CD3 bispecific antibody constructs of the invention stained CHO cells transfected with human DLL3, the artificial DLL3 isoform and with cyno DLL3, and they also stained the human DLL3 positive human lung carcinoma cell line SHP-77 (natural expresser). Human and cyno T cell lines expressing CD3 were also recognized by the bispecific antibody constructs. Moreover, there was no staining of the negative control cells (non-transfected CHO, data shown in Example 6).

Example 6

Confirmation of the Absence of Binding to Human Paralogues

Human DLL3 paralogues DLL1 and DLL4 were stably transfected into CHO cells. The sequences of the paralogues as used in the present Example are identified in the sequence listing (SEQ ID NOs: 283 and 284). Protein expression was confirmed in FACS analyses with antibodies specific for the respective paralogues: Antibodies were anti-human DLL1 MAB1818 (R&D; 5 µg/ml), and anti-human DLL4 MAB1506 (R&D; 5 µg/ml) for DLL4.

Figure 4:
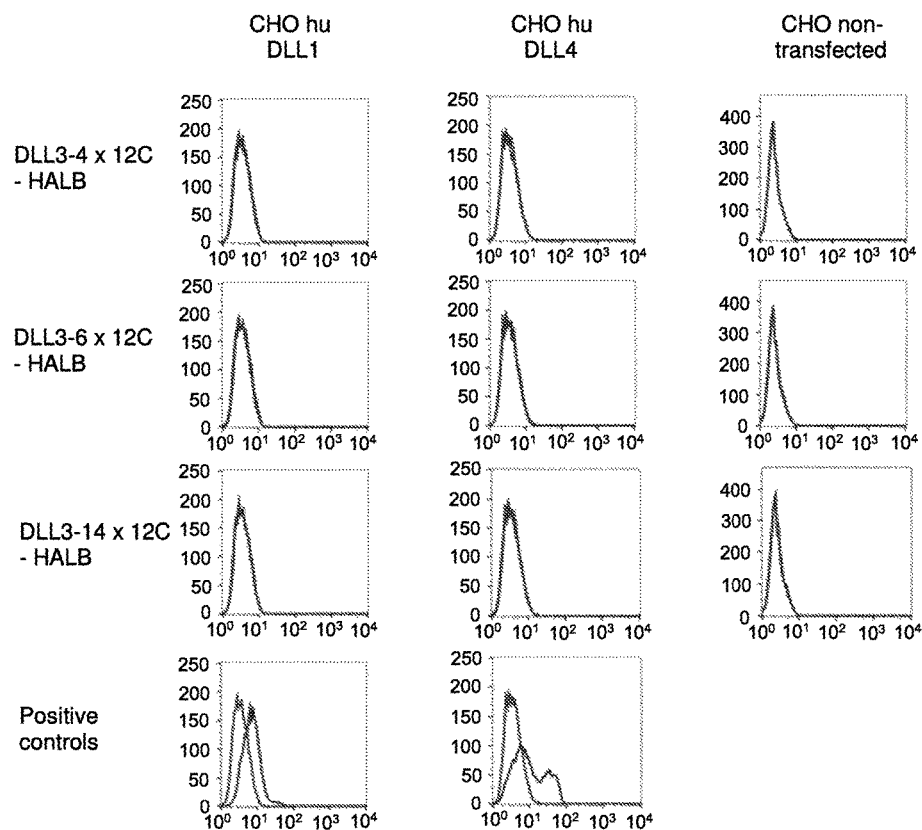

The flow cytometry assay was carried out as described in Example 5, with the exception that bound mouse antibodies were detected with a goat anti-mouse FITC (1:100). The results are shown in FIG. 4. The analysis confirmed that none of the DLL3×CD3 bispecific antibody constructs of the invention cross-reacts with the human DLL3 paralogues DLL1 and DLL4.

Example 7

Identity to Human Germline

In order to analyze the identity/similarity of the sequence of the antibody constructs to the human antibody germline genes, the DLL3 binding domains of the invention were aligned as follows: Full VL including all CDRs was aligned; full VH including CDRs 1 and 2 but except CDR3 was aligned against human antibody germline genes (Vbase). More details can be found in the specification of this application. The results are shown in Table 4 below:

TABLE 4

| Identity of VH and VL to human germline | |
| --- | --- |
| DLL3×CD3 bispecific antibody construct | % identity to human germline [VH/VL] |
| DLL3-4 | 96.9/93.3 |
| DLL3-5 | 96.9/96.6 |

TABLE 4-continued

| Identity of VH and VL to human germline | |
| --- | --- |
| DLL3×CD3 bispecific antibody construct | % identity to human germline [VH/VL] |
| DLL3-6 | 96.9/96.6 |
| DLL3-7 | 93.9/96.6 |
| DLL3-8 | 94.8/96.6 |
| DLL3-9 | 96.9/95.5 |
| DLL3-10 | 91.9/95.5 |
| DLL3-13 | 95.9/95.7 |
| DLL3-14 | 94.9/94.6 |
| DLL3-15 | 93.9/94.6 |

Example 8

Cytotoxic Activity

The potency of DLL3×CD3 bispecific antibody constructs of the invention in redirecting effector T cells against DLL3-expressing target cells was analyzed in five in vitro cytotoxicity assays:

The potency of DLL3×CD3 bispecific antibody constructs in redirecting stimulated human CD8+ effector T cells against human DLL3-transfected CHO cells was measured in an 18 hour 51-chromium release assay.

The potency of DLL3×CD3 bispecific antibody constructs in redirecting stimulated human CD8+ effector T cells against the DLL3 positive human lung carcinoma cell line SHP-77 was measured in an 18 hour 51-chromium release assay.

The potency of DLL3×CD3 bispecific antibody constructs in redirecting the T cells in unstimulated human PBMC against human DLL3-transfected CHO cells was measured in a 48 hour FACS-based cytotoxicity assay.

The potency of DLL3×CD3 bispecific antibody constructs in redirecting the T cells in unstimulated human PBMC against the DLL3-positive human cell line SHP-77 was measured in a 48 hour FACS-based cytotoxicity assay.

For confirmation that the cross-reactive DLL3×CD3 bispecific antibody constructs are capable of redirecting macaque T cells against macaque DLL3-transfected CHO cells, a 48 hour FACS-based cytotoxicity assay was performed with a macaque T cell line as effector T cells.

Example 8.1

Chromium Release Assay with Stimulated Human T Cells

Stimulated T cells enriched for CD8+ T cells were obtained as described in the following. A petri dish (145 mm diameter, Greiner bio-one GmbH, Kremsmünster) was coated with a commercially available anti-CD3 specific antibody (OKT3, Orthoclone) in a final concentration of 1 µg/ml for 1 hour at 37° C. Unbound protein was removed by one washing step with PBS. 3-5×10$^7$ human PBMC were added to the precoated petri dish in 120 ml of RPMI 1640 with stabilized glutamine/10% FCS/IL-2 20 U/ml (Proleukin®, Chiron) and stimulated for 2 days. On the third day, the cells were collected and washed once with RPMI 1640. IL-2 was added to a final concentration of 20 U/ml and the cells were cultured again for one day in the same cell culture medium as above. CD8+ cytotoxic T lymphocytes (CTLs) were enriched by depletion of CD4+ T cells and CD56+ NK cells using Dynal-Beads according to the manufacturer's protocol.

Cyno DLL3- or human DLL3-transfected CHO target cells were washed twice with PBS and labeled with 11.1 MBq $^{51}$Cr in a final volume of 100 µl RPMI with 50% FCS for 60 minutes at 37° C. Subsequently, the labeled target cells were washed 3 times with 5 ml RPMI and then used in the cytotoxicity assay. The assay was performed in a 96-well plate in a total volume of 200 µl supplemented RPMI with an E:T ratio of 10:1. A starting concentration of 0.01-1 µg/ml of purified bispecific antibody construct and threefold dilutions thereof were used. Incubation time for the assay was 18 hours. Cytotoxicity was determined as relative values of released chromium in the supernatant relative to the difference of maximum lysis (addition of Triton-X) and spontaneous lysis (without effector cells). All measurements were carried out in quadruplicates. Measurement of chromium activity in the supernatants was performed in a Wizard 3" gamma counter (Perkin Elmer Life Sciences GmbH, Köln, Germany). Analysis of the results was carried out with Prism 5 for Windows (version 5.0, GraphPad Software Inc., San Diego, Calif., USA). EC50 values calculated by the analysis program from the sigmoidal dose response curves were used for comparison of cytotoxic activity.

Example 8.2

Potency of Redirecting Stimulated Human Effector T Cells Against Human DLL3-Transfected CHO Cells The cytotoxic activity of DLL3×CD3 bispecific antibody constructs according to the invention was analyzed in a 51-chromium ($^{51}$Cr) release cytotoxicity assay using CHO cells transfected with human DLL3 as target cells, and stimulated human CD8+ T cells as effector cells. The experiment was carried out as described in Example 8.1.

The results are shown in Table 5. The DLL3×CD3 bispecific antibody constructs showed very potent cytotoxic activity against human DLL3 transfected CHO cells in the 1-digit picomolar range.

TABLE 5

EC50 values [pM] of DLL3×CD3 bispecific antibody constructs analyzed in a 51-chromium ($^{51}$Cr) release cytotoxicity assay using CHO cells transfected with human DLL3 as target cells, and stimulated human CD8 T cells as effector cells.

| DLL3×CD3 bispecific antibody construct | EC50 [pM] |
|---|---|
| DLL3-4 | 3.8 |
| DLL3-5 | 4.2 |
| DLL3-6 | 2.1 |
| DLL3-7 | 2.2 |
| DLL3-8 | 1.2 |
| DLL3-9 | 1.2 |
| DLL3-10 | 1.4 |
| DLL3-13 | 1.8 |
| DLL3-14 | 5.4 |
| DLL3-15 | 9.8 |

Example 8.3

Potency of Redirecting Stimulated Human Effector T Cells Against the DLL3 Positive Human Lung Carcinoma Cell Line SHP-77

The cytotoxic activity of DLL3×CD3 bispecific antibody constructs was analyzed in a 51-chromium ($^{51}$Cr) release cytotoxicity assay using the DLL3-positive human lung carcinoma cell line SHP-77 as source of target cells, and stimulated human CD8+ T cells as effector cells. The assay was carried out as described in Example 8.1.

In accordance with the results of the 51-chromium release assays with stimulated enriched human CD8+ T lymphocytes as effector cells and human DLL3-transfected CHO cells as target cells, DLL3×CD3 bispecific antibody constructs of the present invention are also potent in cytotoxic activity against natural expresser target cells (see Table 6).

TABLE 6

EC50 values [pM] of DLL3×CD3 bispecific antibody constructs analyzed in an 18-hour 51-chromium ($^{51}$Cr) release cytotoxicity assay with the DLL3-positive human lung carcinoma cell line SHP-77 as source of target cells, and stimulated enriched human CD8 T cells as effector cells. Rows 1-10: Antibody constructs according to the invention, which bind to a DLL3 epitope comprised within the region as depicted in SEQ ID NO: 260. (Rows 1-7: Antibody constructs binding to a DLL3 epitope comprised within the EGF-3 region. Rows 8-10: Antibody constructs binding to a DLL3 epitope comprised within the EGF-4 region.) Rows 11-14: Antibody constructs binding to a DLL3 epitope which is comprised within the EGF-5/[EGF-6] region.

| Row | DLL3×CD3 bispecific antibody construct | EC50 [pM] |
|---|---|---|
| 1 | DLL3-4 | 27 |
| 2 | DLL3-5 | 26 |
| 3 | DLL3-6 | 18 |
| 4 | DLL3-7 | 23 |
| 5 | DLL3-8 | 39 |
| 6 | DLL3-9 | 18 |
| 7 | DLL3-10 | 31 |
| 8 | DLL3-13 | 22 |
| 9 | DLL3-14 | 31 |
| 10 | DLL3-15 | 36 |
| 11 | DLL3-18 | 38 |
| 12 | DLL3-19 | 142 |
| 13 | DLL3-20 | 171 |
| 14 | DLL3-21 | 324 |

Example 8.4

FACS-Based Cytotoxicity Assay with Unstimulated Human PBMC

Isolation of Effector Cells

Human peripheral blood mononuclear cells (PBMC) were prepared by Ficoll density gradient centrifugation from enriched lymphocyte preparations (buffy coats), a side product of blood banks collecting blood for transfusions. Buffy coats were supplied by a local blood bank and PBMC were prepared on the same day of blood collection. After Ficoll density centrifugation and extensive washes with Dulbecco's PBS (Gibco), remaining erythrocytes were removed from PBMC via incubation with erythrocyte lysis buffer (155 mM NH$_4$Cl, 10 mM KHCO$_3$, 100 µM EDTA). Platelets were removed via the supernatant upon centrifugation of PBMC at 100×g. Remaining lymphocytes mainly encompass B and T lymphocytes, NK cells and monocytes. PBMC were kept in culture at 37° C./5% CO$_2$ in RPMI medium (Gibco) with 10% FCS (Gibco).

Depletion of CD14+ and CD56+ Cells

For depletion of CD14+ cells, human CD14 MicroBeads (Milteny Biotec, MACS, #130-050-201) were used, for depletion of NK cells human CD56 MicroBeads (MACS, #130-050-401). PBMC were counted and centrifuged for 10 min at room temperature with 300×g. The supernatant was discarded and the cell pellet resuspended in MACS isolation buffer [80 µL/$10^7$ cells; PBS (Invitrogen, #20012-043), 0.5% (v/v) FBS (Gibco, #10270-106), 2 mM EDTA (Sigma-Aldrich, #E-6511)]. CD14 MicroBeads and CD56 Micro-Beads (20 µL/$10^7$ cells) were added and incubated for 15 min at 4-8° C. The cells were washed with MACS isolation buffer (1-2 mL/$10^7$ cells). After centrifugation (see above), supernatant was discarded and cells resuspended in MACS isolation buffer (500 µL/$10^8$ cells). CD14/CD56 negative cells were then isolated using LS Columns (Miltenyi Biotec, #130-042-401). PBMC w/o CD14+/CD56+ cells were cultured in RPMI complete medium i.e. RPMI1640 (Biochrom AG, #FG1215) supplemented with 10% FBS (Biochrom AG, #S0115), 1× non-essential amino acids (Biochrom AG, #K0293), 10 mM Hepes buffer (Biochrom AG, #L1613), 1 mM sodium pyruvate (Biochrom AG, #L0473) and 100 U/mL penicillin/streptomycin (Biochrom AG, #A2213) at 37° C. in an incubator until needed.

Target Cell Labeling

For the analysis of cell lysis in flow cytometry assays, the fluorescent membrane dye $DiOC_{18}$ (DiO) (Molecular Probes, #V22886) was used to label human DLL3- or macaque DLL3-transfected CHO cells as target cells and distinguish them from effector cells. Briefly, cells were harvested, washed once with PBS and adjusted to $10^6$ cell/mL in PBS containing 2% (v/v) FBS and the membrane dye DiO (5 µL/$10^6$ cells). After incubation for 3 min at 37° C., cells were washed twice in complete RPMI medium and the cell number adjusted to 1.25×$10^5$ cells/mL. The vitality of cells was determined using 0.5% (v/v) isotonic EosinG solution (Roth, #45380).

Flow Cytometry Based Analysis

This assay was designed to quantify the lysis of cyno or human DLL3-transfected CHO cells in the presence of serial dilutions of DLL3 bispecific antibody constructs. Equal volumes of DiO-labeled target cells and effector cells (i.e., PBMC w/o CD14+ cells) were mixed, resulting in an E:T cell ratio of 10:1. 160 µl of this suspension were transferred to each well of a 96-well plate. 40 µL of serial dilutions of the DLL3×CD3 bispecific antibody constructs and a negative control bispecific (a CD3-based bispecific antibody construct recognizing an irrelevant target antigen) or RPMI complete medium as an additional negative control were added. The bispecific antibody-mediated cytotoxic reaction proceeded for 48 hours in a 7% $CO_2$ humidified incubator. Then cells were transferred to a new 96-well plate and loss of target cell membrane integrity was monitored by adding propidium iodide (PI) at a final concentration of 1 µg/mL. PI is a membrane impermeable dye that normally is excluded from viable cells, whereas dead cells take it up and become identifiable by fluorescent emission.

Samples were measured by flow cytometry on a FACSCanto II instrument and analyzed by FACSDiva software (both from Becton Dickinson). Target cells were identified as DiO-positive cells. PI-negative target cells were classified as living target cells. Percentage of cytotoxicity was calculated according to the following formula:

$$\text{Cytotoxicity}[\%] = \frac{n_{dead\ target\ cells}}{n_{target\ cells}} \times 100$$

$n$ = number of events

Using GraphPad Prism 5 software (Graph Pad Software, San Diego), the percentage of cytotoxicity was plotted against the corresponding bispecific antibody construct concentrations. Dose response curves were analyzed with the four parametric logistic regression models for evaluation of sigmoid dose response curves with fixed hill slope and EC50 values were calculated.

Example 8.5

Potency of Redirecting Unstimulated Human PBMC Against Human DLL3-Transfected CHO Cells The cytotoxic activity of DLL3×CD3 bispecific antibody constructs was analyzed in a FACS-based cytotoxicity assay using CHO cells transfected with human DLL3 as target cells, and unstimulated human PBMC as effector cells. The assay was carried out as described in Example 8.4 above.

The results of the FACS-based cytotoxicity assays with unstimulated human PBMC as effector cells and human DLL3-transfected CHO cells as targets are shown in Table 7.

TABLE 7

EC50 values [pM] of DLL3×CD3 bispecific antibody constructs as measured in a 48-hour FACS-based cytotoxicity assay with unstimulated human PBMC as effector cells and CHO cells transfected with human DLL3 as target cells.

| Row | DLL3×CD3 bispecific antibody construct | EC50 [pM] |
| --- | --- | --- |
| 1 | DLL3-4 | 53 |
| 2 | DLL3-5 | 36 |
| 3 | DLL3-6 | 44 |
| 4 | DLL3-7 | 40 |
| 5 | DLL3-8 | 43 |
| 6 | DLL3-9 | 43 |
| 7 | DLL3-10 | 40 |
| 8 | DLL3-13 | 116 |
| 9 | DLL3-14 | 66 |
| 10 | DLL3-15 | 57 |
| 11 | DLL3-18 | 169 |
| 12 | DLL3-19 | 107 |
| 13 | DLL3-20 | 171 |
| 14 | DLL3-21 | 85 |

Rows 1-10: Antibody constructs according to the invention, which bind to a DLL3 epitope comprised within the region as depicted in SEQ ID NO: 260. (Rows 1-7: Antibody constructs binding to a DLL3 epitope comprised within the EGF-3 region. Rows 8-10: Antibody constructs binding to a DLL3 epitope comprised within the EGF-4 region.) Rows 11-14: Antibody constructs binding to a DLL3 epitope which is comprised within the EGF-5/[EGF-6] region.

Expectedly, EC50 values were generally higher in cytotoxicity assays with unstimulated PBMC as effector cells compared with cytotoxicity assays using stimulated human CD8+ T cells (see Example 8.2).

Example 8.6

Potency of Redirecting Unstimulated Human PBMC Against the DLL3-Positive Lung Carcinoma Cell Line SHP-77

The cytotoxic activity of DLL3×CD3 bispecific antibody constructs was furthermore analyzed in a FACS-based cytotoxicity assay using the DLL3-positive human lung carcinoma cell line SHP-77 as a source of target cells and unstimulated human PBMC as effector cells. The assay was carried out as described in Example 8.4 above. The results are shown in Table 8.

TABLE 8

EC50 values [pM] of DLL3xCD3 bispecific antibody constructs as measured in a 48-hour FACS-based cytotoxicity assay with unstimulated human PBMC as effector cells and the human cell line SHP-77 as source of target cells.
Rows 1-10: Antibody constructs according to the invention, which bind to a DLL3 epitope comprised within the region as depicted in SEQ ID NO: 260. (Rows 1-7: Antibody constructs binding to a DLL3 epitope comprised within the EGF-3 region. Rows 8-10: Antibody constructs binding to a DLL3 epitope comprised within the EGF-4 region.) Rows 11-14: Antibody constructs binding to a DLL3 epitope which is comprised within the EGF-5/[EGF-6] region.

| Row | DLL3xCD3 bispecific antibody construct | EC50 [pM] |
|---|---|---|
| 1 | DLL3-4 | 44 |
| 2 | DLL3-5 | 65 |
| 3 | DLL3-6 | 31 |
| 4 | DLL3-7 | 30 |
| 5 | DLL3-8 | 24 |
| 6 | DLL3-9 | 33 |
| 7 | DLL3-10 | 32 |
| 8 | DLL3-13 | 49 |
| 9 | DLL3-14 | 65 |
| 10 | DLL3-15 | 66 |
| 11 | DLL3-18 | 76 |
| 12 | DLL3-19 | 180 |
| 13 | DLL3-20 | 1540 |
| 14 | DLL3-21 | 770 |

Example 8.7

Potency of Redirecting Macaque T Cells Against Macaque DLL3-Expressing CHO Cells Finally, the cytotoxic activity of DLL3xCD3 bispecific antibody constructs was analyzed in a FACS-based cytotoxicity assay using CHO cells transfected with macaque (cyno) DLL3 as target cells, and the macaque T cell line 4119LnPx (Knappe et al. Blood 95:3256-61 (2000)) as source of effector cells. Target cell labeling of macaque DLL3-transfected CHO cells and flow cytometry based analysis of cytotoxic activity was performed as described above.

Results are shown in Table 9. Macaque T cells from cell line 4119LnPx were induced to efficiently kill macaque DLL3-transfected CHO cells by DLL3xCD3 bispecific antibody constructs according to the invention. The antibody constructs presented potently with 2-digit picomolar EC50-values in this assay, confirming that they are very active in the macaque system.

TABLE 9

EC50 values [pM] of DLL3xCD3 bispecific antibody constructs as measured in a 48-hour FACS-based cytotoxicity assay with macaque T cell line 4119LnPx as effector cells and CHO cells transfected with macaque DLL3 as target cells.
Rows 1-10: Antibody constructs according to the invention, which bind to a DLL3 epitope comprised within the region as depicted in SEQ ID NO: 260. (Rows 1-7: Antibody constructs binding to a DLL3 epitope comprised within the EGF-3 region. Rows 8-10: Antibody constructs binding to a DLL3 epitope comprised within the EGF-4 region.) Rows 11-14: Antibody constructs binding to a DLL3 epitope which is comprised within the EGF-5/[EGF-6] region.

| Row | DLL3xCD3 bispecific antibody construct | EC50 [pM] |
|---|---|---|
| 1 | DLL3-4 | 36 |
| 2 | DLL3-5 | 42 |
| 3 | DLL3-6 | 40 |
| 4 | DLL3-7 | 101 |
| 5 | DLL3-8 | 44 |
| 6 | DLL3-9 | 58 |
| 7 | DLL3-10 | 42 |
| 8 | DLL3-13 | 65 |
| 9 | DLL3-14 | 28 |
| 10 | DLL3-15 | 32 |
| 11 | DLL3-18 | 134 |
| 12 | DLL3-19 | 66 |
| 13 | DLL3-20 | 231 |
| 14 | DLL3-21 | 86 |

Example 9

Monomer to Dimer Conversion after (i) Three Freeze/Thaw Cycles and (ii) 7 Days of Incubation at 250 µg/ml Bispecific DLL3xCD3 antibody monomeric construct were subjected to different stress conditions followed by high performance SEC to determine the percentage of initially monomeric antibody construct, which had been converted into dimeric antibody construct.

(i) 25 µg of monomeric antibody construct were adjusted to a concentration of 250 µg/ml with generic formulation buffer and then frozen at −80° C. for 30 min followed by thawing for 30 min at room temperature. After three freeze/thaw cycles the dimer content was determined by HP-SEC.

(ii) 25 µg of monomeric antibody construct were adjusted to a concentration of 250 µg/ml with generic formulation buffer followed by incubation at 37° C. for 7 days. The dimer content was determined by HP-SEC.

A high resolution SEC Column TSK Gel G3000 SWXL (Tosoh, Tokyo-Japan) was connected to an Äkta Purifier 10 FPLC (GE Lifesciences) equipped with an A905 Autosampler. Column equilibration and running buffer consisted of 100 mM KH2PO4-200 mM Na2SO4 adjusted to pH 6.6. The antibody solution (25 µg protein) was applied to the equilibrated column and elution was carried out at a flow rate of 0.75 ml/min at a maximum pressure of 7 MPa. The whole run was monitored at 280, 254 and 210 nm optical absorbance. Analysis was done by peak integration of the 210 nm signal recorded in the Äkta Unicorn software run evaluation sheet. Dimer content was calculated by dividing the area of the dimer peak by the total area of monomer plus dimer peak.

The results are shown in Table 10 below. The DLL3xCD3 bispecific antibody constructs of the invention presented with dimer percentages of 0.0% after three freeze/thaw cycles, and with dimer percentages of ≤2% after 7 days of incubation at 37° C.

TABLE 10

Percentage of monomeric versus dimeric DLL3xCD3 bispecific antibody constructs as determined by High Performance Size Exclusion Chromatography (HP-SEC).

| DLL3xCD3 bispecific antibody construct | Percentage of dimer after three freeze/thaw cycles | Percentage of dimer after 7 days of incubation at 37° C. |
|---|---|---|
| DLL3-4 | 0.7 | 0.0 |
| DLL3-5 | 1.5 | 0.0 |
| DLL3-6 | 1.3 | 0.0 |
| DLL3-7 | 1.2 | 0.0 |
| DLL3-8 | 1.5 | 0.0 |
| DLL3-9 | 1.8 | 0.0 |
| DLL3-10 | 0.6 | 0.0 |
| DLL3-13 | 1.6 | 0.0 |
| DLL3-14 | 0.4 | 0.0 |
| DLL3-15 | 1.2 | 0.0 |

Example 10

Thermostability

Antibody aggregation temperature was determined as follows: 40 µl of antibody construct solution at 250 µg/ml were transferred into a single use cuvette and placed in a Wyatt Dynamic Light Scattering device DynaPro Nanostar (Wyatt). The sample was heated from 40° C. to 70° C. at a heating rate of 0.5° C./min with constant acquisition of the measured radius. Increase of radius indicating melting of the protein and aggregation was used by the software package delivered with the DLS device to calculate the aggregation temperature of the antibody construct.

All tested DLL3×CD3 bispecific antibody constructs of the invention showed thermal stability with aggregation temperatures ≥45° C., as shown in Table 11 below. The group of antibody constructs binding to an epitope of DLL3 which is comprised within the EGF-4 region (as depicted in SEQ ID NO: 259) even had a thermal stability of ≥50° C., more precisely, of ≥54° C.

TABLE 11

Thermostability of the bispecific antibody constructs as determined by DLS (dynamic light scattering)

| DLL3xCD3 bispecific antibody construct | Thermostability (DLS ° C. aggregation) |
|---|---|
| DLL3-4 | 59.3 |
| DLL3-5 | 45.4 |
| DLL3-6 | 58.8 |
| DLL3-7 | 58.2 |
| DLL3-8 | 49.8 |
| DLL3-9 | 49.6 |
| DLL3-10 | 52.9 |
| DLL3-13 | 54.0 |
| DLL3-14 | 57.0 |
| DLL3-15 | 56.3 |

Example 11

Stability after Incubation for 24 Hours in Human Plasma

Purified bispecific antibody constructs were incubated at a ratio of 1:5 in a human plasma pool at 37° C. for 96 hours at a final concentration of 2-20 µg/ml. After plasma incubation the antibody constructs were compared in a 51-chromium release assay with stimulated enriched human CD8+ T cells and human DLL3-transfected CHO cells at a starting concentration of 0.01-0.1 µg/ml and with an effector to target cell (E:T) ratio of 10:1 (assay as described in Example 8.1). Non-incubated, freshly thawed bispecific antibody constructs were included as controls.

Figure 5:
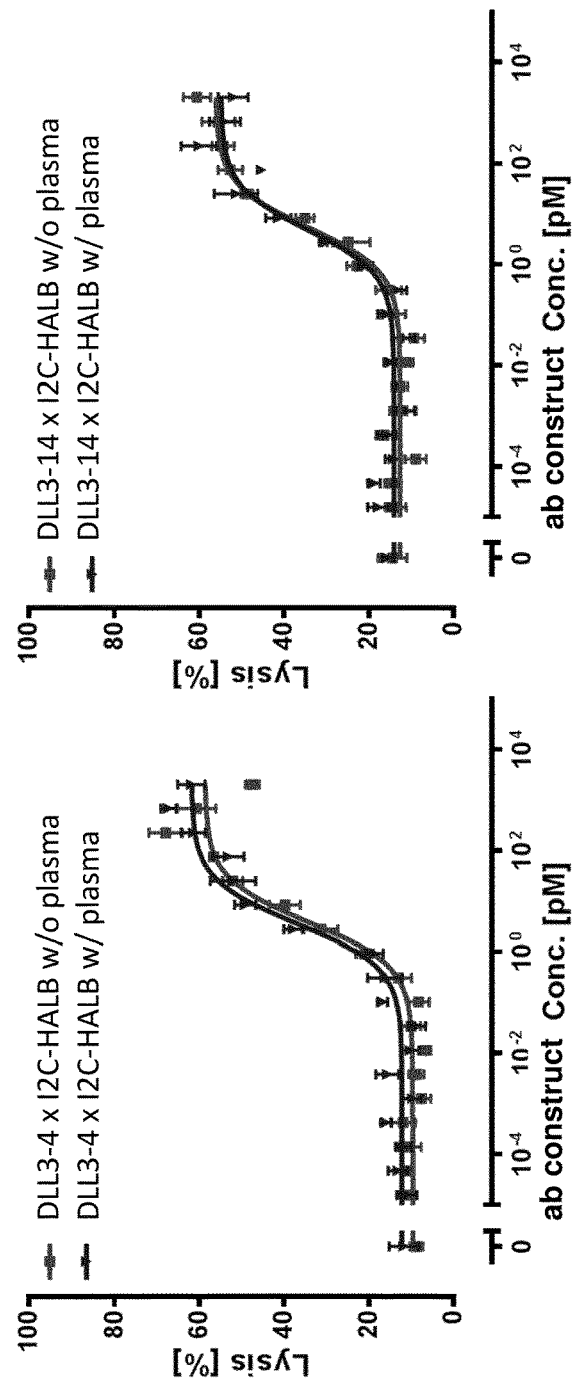

The results are shown in Table 12 below; exemplary results for the two antibody constructs DLL-4 and DLL-14 are also shown in FIG. 5. All tested antibody constructs had a very favourable plasma stability (EC50 plasma/EC50 control) of ≤2.5. The group of antibody constructs binding to an epitope of DLL3 which is comprised within the EGF-4 region (as depicted in SEQ ID NO: 259) even had a plasma stability of ≤1.5, more precisely, of ≤1.1.

TABLE 12

EC50 values of the antibody constructs with and without plasma incubation and calculated plasma/control value

| DLL3xCD3 bispecific antibody construct | $EC_{50}$ [pM] w/plasma | $EC_{50}$ [pM] w/o plasma | Plasma to Control ratio ($EC_{50}$ plasma/ $EC_{50}$ control) |
|---|---|---|---|
| DLL3-4 | 3.6 | 3.8 | 0.9 |
| DLL3-5 | 5.4 | 4.2 | 1.3 |
| DLL3-6 | 4.8 | 2.1 | 2.3 |
| DLL3-7 | 2.7 | 2.2 | 1.2 |
| DLL3-8 | 1.0 | 1.2 | 0.8 |
| DLL3-9 | 1.2 | 1.2 | 1.0 |
| DLL3-10 | 2.5 | 1.4 | 1.8 |
| DLL3-13 | 2.0 | 1.8 | 1.1 |
| DLL3-14 | 4.8 | 5.4 | 0.9 |
| DLL3-15 | 7.8 | 9.8 | 0.8 |

Example 12

Turbidity at 2500 µg/ml Antibody Concentration 1 ml of purified antibody construct solution of a concentration of 250 µg/ml was concentrated by spin concentration units to 2500 µg/ml. After 16 h storage at 5° C. the turbidity of the antibody solution was determined by OD340 nm optical absorption measurement against the generic formulation buffer.

The results are shown in Table 13 below. All tested antibody constructs have a very favourable turbidity of ≤0.1, with the exception of one construct with a turbidity slightly above 0.1. The group of antibody constructs binding to an epitope of DLL3 which is comprised within the EGF-4 region (as depicted in SEQ ID NO: 259) even have a turbidity of ≤0.08.

TABLE 13

Turbidity of the antibody constructs after concentration to 2.5 mg/ml over night

| DLL3xCD3 bispecific antibody construct | Turbidity at 2500 µg/ml [OD340] |
|---|---|
| DLL3-4 | 0.073 |
| DLL3-5 | 0.106 |
| DLL3-6 | 0.080 |
| DLL3-7 | 0.089 |
| DLL3-8 | 0.069 |
| DLL3-9 | 0.085 |
| DLL3-10 | 0.091 |
| DLL3-13 | 0.075 |
| DLL3-14 | 0.073 |
| DLL3-15 | 0.078 |

Example 13

Protein Homogeneity by High Resolution Cation Exchange Chromatography

The protein homogeneity the antibody constructs of the invention was analyzed by high resolution cation exchange chromatography CIEX.

50 µg of antibody construct monomer were diluted with 50 ml binding buffer A (20 mM sodium dihydrogen phosphate, 30 mM NaCl, 0.01% sodium octanate, pH 5.5), and 40 ml of this solution were applied to a 1 ml BioPro SP-F column (YMC, Germany) connected to an Äkta Micro FPLC device (GE Healthcare, Germany). After sample binding, a wash step with further binding buffer was carried out. For protein elution, a linear increasing salt gradient using buffer B (20 mM sodium dihydrogen phosphate, 1000 mM NaCl, 0.01% sodium octanate, pH 5.5) up to 50% percent buffer B was applied over 10 column volumes. The whole run was monitored at 280, 254 and 210 nm optical absorbance. Analysis was done by peak integration of the 280 nm signal recorded in the Äkta Unicorn software run evaluation sheet.

The results are shown in Table 14 below. All tested antibody constructs have a very favourable homogeneity of ≥80% (area under the curve (=AUC) of the main peak), The group of antibody constructs binding to an epitope of DLL3 which is comprised within the EGF-3 region (as depicted in SEQ ID NO: 258) even have a homogeneity of ≥90%.

TABLE 14

Protein homogeneity of the antibody constructs (% AUC of main peak)

| DLL3xCD3 bispecific antibody construct | Protein homogeneity % AUC of main peak |
|---|---|
| DLL3-4 | 96 |
| DLL3-5 | 100 |
| DLL3-6 | 95 |
| DLL3-7 | 93 |
| DLL3-8 | 100 |
| DLL3-9 | 93 |
| DLL3-10 | 90 |
| DLL3-13 | 100 |
| DLL3-14 | 100 |
| DLL3-15 | 83 |

Example 14

Surface Hydrophobicity as Measured by HIC Butyl

The surface hydrophobicity of bispecific antibody constructs of the invention was tested in Hydrophobic Interaction Chromatography HIC in flow-through mode.

50 µg of antibody construct monomer were diluted with generic formulation buffer to a final volume of 500 µl (10 mM citric acid, 75 mM lysine HCl, 4% trehalose, pH 7.0) and applied to a 1 ml Butyl Sepharose FF column (GE Healthcare, Germany) connected to a Äkta Purifier FPLC system (GE Healthcare, Germany). The whole run was monitored at 280, 254 and 210 nm optical absorbance. Analysis was done by peak integration of the 280 nm signal recorded in the Äkta Unicorn software run evaluation sheet. Elution behavior was evaluated by comparing area and velocity of rise and decline of protein signal thereby indicating the strength of interaction of the BiTE albumin fusion with the matrix.

The antibody constructs had a good elution behaviour, which was mostly rapid and complete.

Example 15

Potency Gap Between the Monomeric and the Dimeric Isoform of Bispecific Antibody Constructs In order to determine the difference in cytotoxic activity between the monomeric and the dimeric isoform of individual DLL3xCD3 bispecific antibody constructs (referred to as potency gap), an 18 hour 51-chromium release cytotoxicity assay was carried out as described hereinabove (Example 8.1) with purified bispecific antibody construct monomer and dimer. Effector cells were stimulated enriched human CD8+ T cells. Target cells were hu DLL3 transfected CHO cells. Effector to target cell (E:T) ratio was 10:1. The potency gap was calculated as ratio between EC50 values.

Figure 6:
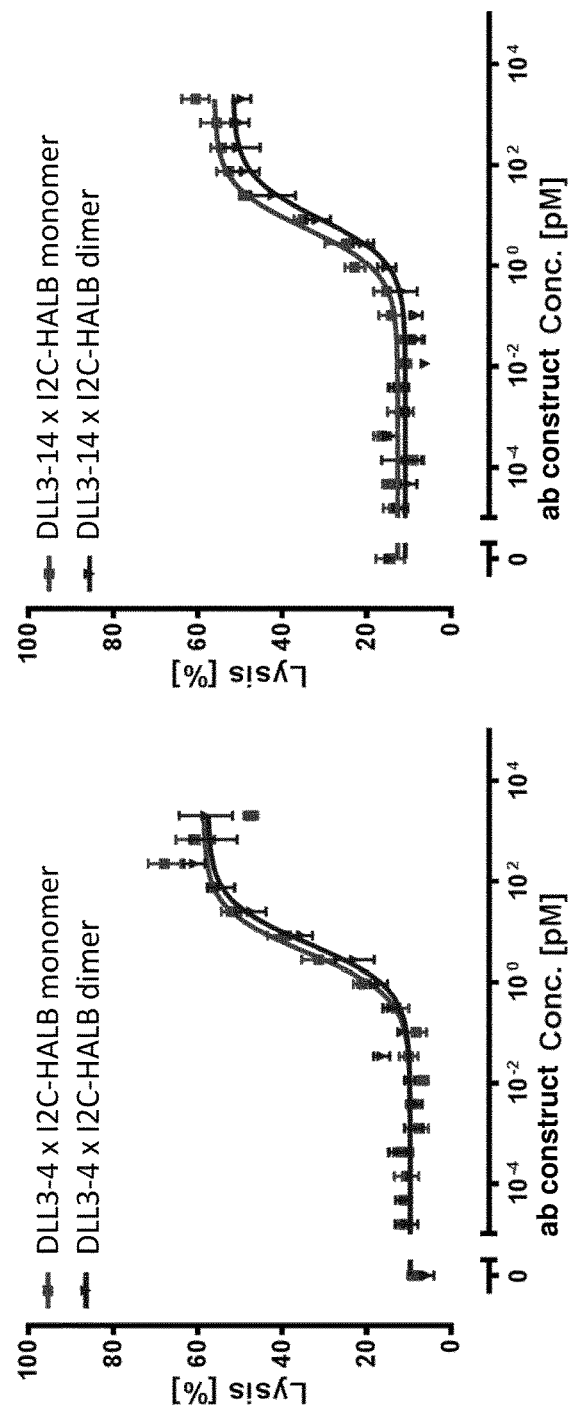

The results are shown in Table 15 below; exemplary results for the two antibody constructs DLL-4 and DLL-14 are also shown in FIG. 6. Potency gaps of the tested DLL3xCD3 bispecific antibody constructs were between 0.2 and 1.0. There is hence no substantially more active dimer compared to its respective monomer.

TABLE 15

Potency gap between the monomeric and the dimeric isoform

| DLL3xCD3 bispecific antibody construct | $EC_{50}$ [pM] monomer | $EC_{50}$ [pM] dimer | Ratio $EC_{50}$ monomer/ $EC_{50}$ dimer |
|---|---|---|---|
| DLL3-4 | 3.8 | 5.7 | 0.7 |
| DLL3-5 | 4.2 | 11 | 0.4 |
| DLL3-6 | 2.1 | 13 | 0.2 |
| DLL3-7 | 2.2 | 4.2 | 0.5 |
| DLL3-8 | 1.2 | 3.4 | 0.4 |
| DLL3-9 | 1.2 | 3.8 | 0.3 |
| DLL3-10 | 1.4 | 1.4 | 1.0 |
| DLL3-13 | 1.8 | 3.0 | 0.6 |
| DLL3-14 | 5.4 | 8.7 | 0.6 |
| DLL3-15 | 9.8 | 25 | 0.4 |

Example 16

In Vitro Internalization Assay

Figure 7:
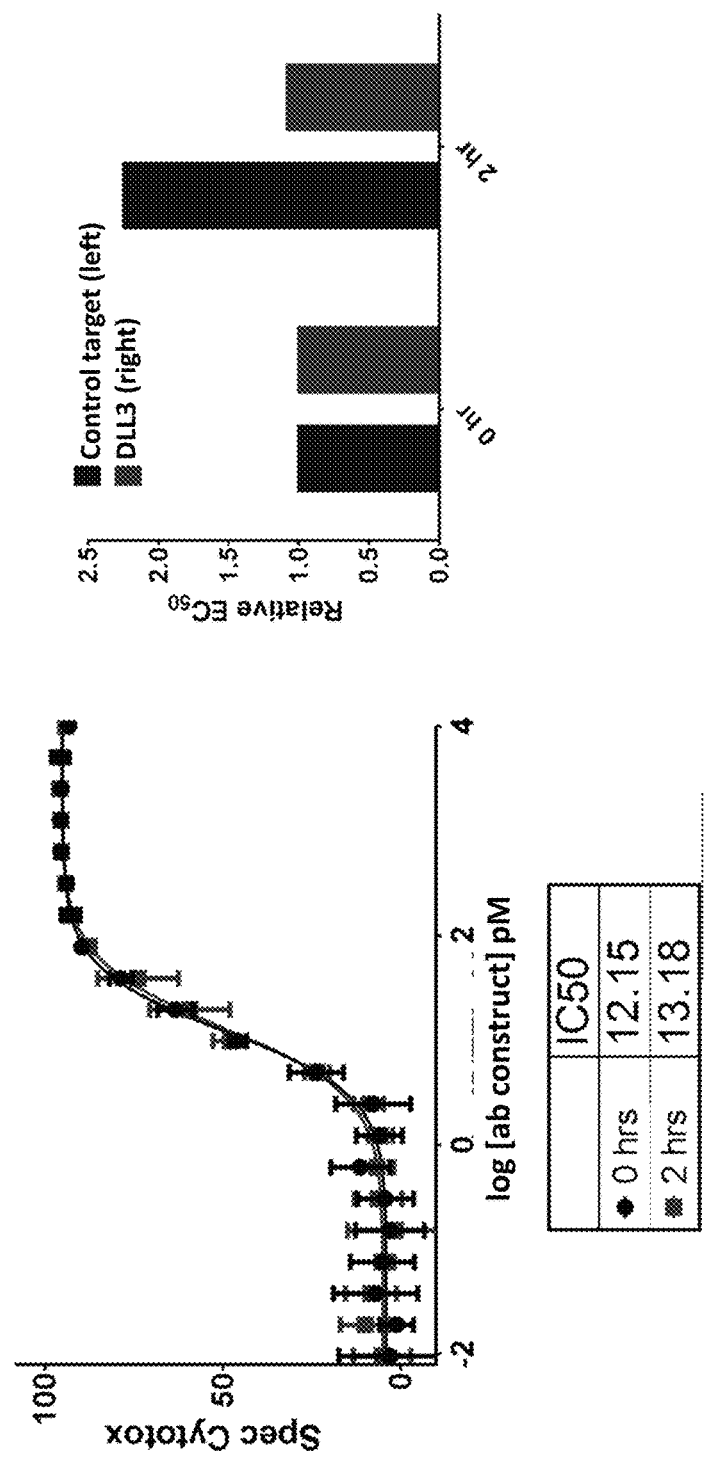

Changes in the potency of the DLL3xCD3 bispecific antibody construct as a function of preincubation of the construct on the target cells in the absence of T cells were measured. If the antibody construct is internalized, it should undergo lysosomal degradation. The effective concentration should decrease with time, and thus the apparent potency should decrease as well. The effect is observed with other targets, for which this is a known phenomenon, but no impact was observed with the DLL3xCD3 bispecific antibody construct. The assay was carried out as follows:

T cells were counted and diluted to a concentration of $1 \times 10^5$/ml in assay media. SHP-77 cells were counted and plated at 2500 cells per well (cpw). The antibody construct was diluted serially 1:2 (with Bravo), at a starting concentration of 100 nM. The antibody construct was added to the culture assay plates to allow for 0 hours, 1 hour or 2 hours of incubation prior to addition of the T cells. Then the T cells were plated at 25000 cpw, and the assay was incubated for 48 hours at 37° C. SHP-77 cell survival was analyzed with the Steady-Glo® system (25 µl/well). The results are shown in FIG. 7 and suggest no significant internalization of the antibody construct DLL3-4xCD3 (I2C).

Example 17

Shedding Study

In order to analyze whether the cytotoxic activity of the DLL3×CD3 bispecific antibody constructs of the invention is significantly impaired by the presence of shed DLL, the following assay was carried out: T cells were counted and diluted to a concentration of 1×10$^5$/ml in assay media. SHP-77 cells were counted and diluted to a concentration of 1.25×10$^5$/ml in assay media with increasing concentrations of soluble DLL3 between 0.3 nM and 12 nM. SHP-77 cells were plated at 2500 cells per well (cpw), and T cells were added at 25000 cpw. The antibody construct was diluted serially 1:2 (with Bravo), and added to the culture assay (with Bravo). Incubation occurred for 48 hours at 37° C. SHP-77 cell survival was analyzed with the Steady-Glo® system (25 µl/well).

Example 18

Mouse Xenograft Efficacy Study

The anti-tumor activity of an HLE DLL3×CD3 bispecific antibody construct (SEQ ID NO: 517) was tested in a model of female NOD/SCID mice which were subcutaneously injected on day 1 of the study with 5×10$^6$ human DLL3 positive SCLC (SHP-77 luc) or 5×10$^6$ human DLL3 positive melanoma (WM 266-4) cells. Effector cells (2×10$^7$ in vitro expanded and activated living human CD3+ T cells) were injected intraperitoneally on day 12. Treatment start was on day 16 (WM 266-4) or on day 18 (SHP-77 luc). The antibody construct was administered four times every five days (q5dx4) by i.v. bolus injections. The treatment groups were as follows:

SCLC model (SHP-77 luc)/7 mice per group
  Vehicle-treated group with T cells
  DLL3×CD3 bispecific antibody construct: 10 mg/kg per administration
Melanoma model (WM266-4)/9 mice per group
  Vehicle-treated group with T cells
  DLL3×CD3 bispecific antibody construct: 10 mg/kg per administration
  DLL3×CD3 bispecific antibody construct: 2 mg/kg per administration Tumors were measured by caliper during the study and progress evaluated by intergroup comparison of tumor volumes (TV). The tumor growth inhibition T/C [%] on day x is determined by calculating the tumor volume as T/C (%)=100×(median TV of analyzed group)/(median TV of control group), and the calculated values are depicted in the following table 16:

TABLE 16

T/C values of the mouse xenograft studies with SHP-77 luc cells and WM266-4 cells

| Day of Study | T/C (%) SHP-77 model 10 mg/kg | T/C (%) WM266-4 model 10 mg/kg | T/C (%) WM266-4 model 2 mg/kg |
|---|---|---|---|
| 15 | 103 | 101 | 101 |
| 17 | 92 | 76 | 77 |
| 20 | 64 | 42 | 47 |
| 23 | 50 | 36 | 38 |
| 26 | 52 | 31 | 35 |
| 29 | 34 | 46 | 40 |
| 31 | 33 | 56 | 55 |
| 33 | 30 | 64 | 75 |
| 36 | 24 | n.a | n.a |
| 38 | 19 | n.a | n.a |

The results are furthermore shown in FIGS. 8A and 8B. Significant tumor growth inhibition was shown in both tumor models and at both tested dose levels of 2 and 10 mg/kg.

Example 19

Cyno Exploratory Toxicology Study

An exploratory toxicology study was carried out with a non half-life extended DLL3×CD3 bispecific antibody construct (SEQ ID NO: 554). Three female cynomolgus monkeys were dosed via continuous i.v. infusion for 16 days (5, 15, and 45 µg/kg/day for 3 days each, followed by 100 µg/kg/day for 7 days). No test article-related clinical observations, changes in body temperature, food consumption or body weight were observed.

Consistent with expectations for the pharmacology of a DLL3×CD3 bispecific antibody construct, circulating T lymphocyte populations (total T-lymphocytes, T-helper and T-cytotoxic lymphocytes, NK cells, B-lymphocytes, and CD25+ activated T-lymphocytes) were decreased on the first day of dosing and remained lower throughout the duration of the study in all animals. Activation markers (CD69 and CD25 on activated T cells) were increased on day 1, but not at later time points in the study.

To summarize, the DLL3×CD3 bispecific antibody construct was very well tolerated even at the highest dose tested (100 µg/kg/d, >300×EC$_{50}$).

Example 20

Cyno PK Studys

A cyno PK study was performed with naïve male cynomolgus monkeys. Three different albumin-fused DLL3×CD3 (I2C) bispecific antibody constructs (DLL3-4, DLL3-6 and DLL3-14) were administered as i.v. single bolus at a concentration of 12 µg/kg. For each of the molecules a group of two animals was used.

A separate cyno PK study was performed under the same conditions, but with DLL3-4 in different Fc fusion versions.

Blood samples were collected pre-dose and at 0.05, 0.5, 1, 4, 8, 24, 48, 72, 120, 168, 240, and 336 hours post-dose. Serum was prepared for determination of serum concentrations of the molecules in an immunoassay. The assay was performed by capturing the antibody constructs via their target moiety, while an antibody directed against the CD3-binding part of the construct was used for detection. The serum concentration-time profiles were used to determine PK parameters. The pharmacokinetic parameters were determined using standard non-compartmental analysis (NCA) methods. The following PK parameters were assessed: $AUC_{inf}$ (Area under the serum concentration—time curve), $V_{ss}$ (volume of distribution at steady state), CL (systemic clearance) and terminal $t_{1/2}$ (terminal half-life). For all antibody constructs, serum levels were quantifiable for all time points in all animals after their administration. No clinical observations were made in any of the treated animals.

The pharmacokinetics of the tested antibody constructs are shown in FIGS. 9A and 9B, and the PK parameters are summarized as mean of n=2 in table 17 below.

The albumin-fused constructs showed a favorable PK profile consistent with a once or twice weekly dosing schedule in a human patient. An even more favorable PK profile supporting once weekly dosing or even every other week dosing was observed with an Fc fusion construct (scFc).

TABLE 17

Pharmacokinetic parameters of HLE variants of DLL3xCD3 bispecific antibody constructs in cynomolgus monkeys

| Antibody construct | $AUC_{inf}$ [ng * h/mL] | $V_{SS}$ [mL/kg] | CL [mL/h/kg] | $t_{1/2}$ [h] |
|---|---|---|---|---|
| DLL3-4 x I2C HALB | 20,669 | 70 | 0.58 | 98 |
| DLL3-6 x I2C HALB | 20,228 | 67 | 0.59 | 103 |
| DLL3-14 x I2C HALB | 21,597 | 107 | 0.55 | 154 |
| DLL3-4 x I2C scFc | 29,746 | 118 | 0.40 | 213 |
| DLL3-4 (cc) x I2C scFc | 24,769 | 144 | 0.48 | 234 |
| DLL3-4 x I2C hetero Fc | 14,639 | 166 | 0.82 | 173 |

TABLE 18

| SEQ ID NO | DLL3-epitope | Designation | Format / Source | Amino acid sequence |
|---|---|---|---|---|
| 1 | | DLL3-1 | VH CDR1 | DYGIH |
| 2 | | DLL3-1 | VH CDR2 | VISYHGSNKYYARSVKG |
| 3 | | DLL3-1 | VH CDR3 | EIPFGMDV |
| 4 | | DLL3-1 | VL CDR1 | RSSQSLLHSDGYNYLD |
| 5 | | DLL3-1 | VL CDR2 | LGSNRAS |
| 6 | | DLL3-1 | VL CDR3 | MQALQTPLT |
| 7 | | DLL3-1 | VH | QVQLVESGGGVVQSGRSLRLSCAASGFTFSDYGIHWVRQAPGKGLEWVAVISYHGSNKYYAR SVKGRFTVSRDNSKNTLYLQMNSLRAEDTAVYYCAREIPFGMDVWGQGTTVTVSS |
| 8 | | DLL3-1 | VL | DIVMTQTPLSLPVTPGEPASISCRSSQSLLHSDGYNYLDWYLQKPGQSPQLLIYLGSNRASG VPDRFSGSGSGTDFTLTISRVEAEDVGVYYCMQALQTPLTFGGGTKVDIK |
| 9 | N-term | DLL3-1 | scFv | QVQLVESGGGVVQSGRSLRLSCAASGFTFSDYGIHWVRQAPGKGLEWVAVISYHGSNKYYAR SVKGRFTVSRDNSKNTLYLQMNSLRAEDTAVYYCAREIPFGMDVWGQGTTVTVSSGGGGSGG GGSGGGGSDIVMTQTPLSLPVTPGEPASISCRSSQSLLHSDGYNYLDWYLQKPGQSPQLLIY LGSNRASGVPDRFSGSGSGTDFTLTISRVEAEDVGVYYCMQALQTPLTFGGGTKVDIK |
| 10 | | DLL3-1 xI2C | bispecific molecule | QVQLVESGGGVVQSGRSLRLSCAASGFTFSDYGIHWVRQAPGKGLEWVAVISYHGSNKYYAR SVKGRFTVSRDNSKNTLYLQMNSLRAEDTAVYYCAREIPFGMDVWGQGTTVTVSSGGGGSGG GGSGGGGSDIVMTQTPLSLPVTPGEPASISCRSSQSLLHSDGYNYLDWYLQKPGQSPQLLIY LGSNRASGVPDRFSGSGSGTDFTLTISRVEAEDVGVYYCMQALQTPLTFGGGTKVDIKSGGG GSEVQLVESGGGLVQPGGSLKLSCAASGFTFNKYAMNWVRQAPGKGLEWVARIRSKYNNYAT YYADSVKDRFTISRDDSKNTAYLQMNNLKTEDTAVYYCVRHGNFGNSYISYWAYWGQGTLVT VSSGGGGSGGGGSGGGGSQTVVTQEPSLTVSPGGTVTLTCGSSTGAVTSGNYPNWVQQKPGQ APRGLIGGTKFLAPGTPARFSGSLLGGKAALTLSGVQPEDEAEYYCVLWYSNRWVFGGGTKL TVL |
| 11 | | DLL3-2 | VH CDR1 | GYYMH |
| 12 | | DLL3-2 | VH CDR2 | WINPNSGDTNYAQKFQG |
| 13 | | DLL3-2 | VH CDR3 | DANIAALDAFEI |
| 14 | | DLL3-2 | VL CDR1 | RASQSISSYLN |
| 15 | | DLL3-2 | VL CDR2 | AASSLQS |
| 16 | | DLL3-2 | VL CDR3 | QQSYSTPLT |
| 17 | | DLL3-2 | VH | QVQLVQSGAEVKKPGASVKVSCKASGYTFTGYYMHWVRQAPGQGLEWMGWINPNSGDTNYAQ KFQGRVTMTRDTSISTAYMELSRLTSDDTAVYYCARDANIAALDAFEIWGQGTMVTVSS |
| 18 | | DLL3-2 | VL | DIQMTQSPSSLSASVGDRVTITCRASQSISSYLNWYQQKPGKAPKLLIYAASSLQSGVPSRF SGSGSGTDFTLTISSLQPEDFATYYCQQSYSTPLTFGGGTKVEIK |

TABLE 18-continued

| SEQ ID NO | DLL3-epitope | Designation | Format / Source | Amino acid sequence |
|---|---|---|---|---|
| 19 | N-term. | DLL3-2 | scFv | QVQLVQSGAEVKKPGASVKVSCKASGYTFTGYYMHWVRQAPGQGLEWMGWINPNSGDTNYAQ KFQGRVTMTRDTSISTAYMELSRLTSDDTAVYYCARDANIAALDAFEIWGQGTMVTVSSGGG GSGGGGSGGGGSDIQMTQSPSSLSASVGDRVTITCRASQSISSYLNWYQQKPGKAPKLLIYA ASSLQSGVPSRFSGSGSGTDFTLTISSLQPEDFATYYCQQSYSTPLTFGGGTKVEIK |
| 20 | | DLL3-2 xI2C | bispecific molecule | QVQLVQSGAEVKKPGASVKVSCKASGYTFTGYYMHWVRQAPGQGLEWMGWINPNSGDTNYAQ KFQGRVTMTRDTSISTAYMELSRLTSDDTAVYYCARDANIAALDAFEIWGQGTMVTVSSGGG GSGGGGSGGGGSDIQMTQSPSSLSASVGDRVTITCRASQSISSYLNWYQQKPGKAPKLLIYA ASSLQSGVPSRFSGSGSGTDFTLTISSLQPEDFATYYCQQSYSTPLTFGGGTKVEIKSGGGG SEVQLVESGGGLVQPGGSLKLSCAASGFTFNKYAMNWVRQAPGKGLEWVARIRSKYNNYATY YADSVKDRFTISRDDSKNTAYLQMNNLKTEDTAVYYCVRHGNFGNSYISYWAYWGQGTLVTV SSGGGGSGGGGSGGGGSQTVVTQEPSLTVSPGGTVTLTCGSSTGAVTSGNYPNWVQQKPGQA PRGLIGGTKFLAPGTPARFSGSLLGKAALTLSGVQPEDEAEYYCVLWYSNRWVFGGGTKLT VL |
| 21 | | DLL3-3 | VH CDR1 | SYGMH |
| 22 | | DLL3-3 | VH CDR2 | VISYHGRDTYYARSVKG |
| 23 | | DLL3-3 | VH CDR3 | DGATVTSYYYSGMDV |
| 24 | | DLL3-3 | VL CDR1 | RASQGISNYLA |
| 25 | | DLL3-3 | VL CDR2 | LASSLQS |
| 26 | | DLL3-3 | VL CDR3 | QQYNFYPFT |
| 27 | | DLL3-3 | VH | QVQLVESGGGVVQPGRSLRLSCAASGFTFSSYGMHWVRQAPGKGLEWVAVISYHGRDTYYAR SVKGRFTISRDNSKNTLYLHMNSLRAEDTAVYYCARDGATVTSYYYSGMDVWGQGTTVTVSS K |
| 28 | | DLL3-3 | VL | DIQMTQSPSSLSASVGDRVTITCRASQGISNYLAWFQQKPGKAPKSLIYLASSLQSGVPSKF SGSGSGTDFTLTISSLQPEDFATYYCQQYNFYPFTFGPGTKVDIK |
| 29 | EGF-1 | DLL3-3 | scFv | QVQLVESGGGVVQPGRSLRLSCAASGFTFSSYGMHWVRQAPGKGLEWVAVISYHGRDTYYAR SVKGRFTISRDNSKNTLYLHMNSLRAEDTAVYYCARDGATVTSYYYSGMDVWGQGTTVTVSS GGGGSGGGGSGGGGSDIQMTQSPSSLSASVGDRVTITCRASQGISNYLAWFQQKPGKAPKSL IYLASSLQSGVPSKFSGSGSGTDFTLTISSLQPEDFATYYCQQYNFYPFTFGPGTKVDIK |
| 30 | | DLL3-3 xI2C | bispecific molecule | QVQLVESGGGVVQPGRSLRLSCAASGFTFSSYGMHWVRQAPGKGLEWVAVISYHGRDTYYAR SVKGRFTISRDNSKNTLYLHMNSLRAEDTAVYYCARDGATVTSYYYSGMDVWGQGTTVTVSS GGGGSGGGGSGGGGSDIQMTQSPSSLSASVGDRVTITCRASQGISNYLAWFQQKPGKAPKSL IYLASSLQSGVPSKFSGSGSGTDFTLTISSLQPEDFATYYCQQYNFYPFTFGPGTKVDIKSG GGGSEVQLVESGGGLVQPGGSLKLSCAASGFTFNKYAMNWVRQAPGKGLEWVARIRSKYNNY ATYYADSVKDRFTISRDDSKNTAYLQMNNLKTEDTAVYYCVRHGNFGNSYISYWAYWGQGTL VTVSSGGGGSGGGGSGGGGSQTVVTQEPSLTVSPGGTVTLTCGSSTGAVTSGNYPNWVQQKP GQAPRGLIGGTKFLAPGTPARFSGSLLGKAALTLSGVQPEDEAEYYCVLWYSNRWVFGGGT KLTVL |
| 31 | DLL3-4 | | VH CDR1 | SYYWS |
| 32 | | DLL3-4 | VH CDR2 | YVYYSGTTNYNPSLKS |
| 33 | | DLL3-4 | VH CDR3 | IAVTGFYFDY |
| 34 | | DLL3-4 | VL CDR1 | RASQRVNNNYLA |
| 35 | | DLL3-4 | VL CDR2 | GASSRAT |
| 36 | | DLL3-4 | VL CDR3 | QQYDRSPLT |
| 37 | | DLL3-4 | VH | QVQLQESGPGLVKPSETLSLTCTVSGGSISSYYWSWIRQPPGKGLEWIGYVYYSGTTNYNPS LKSRVTISVDTSKNQFSLKLSSVTAADTAVYYCASIAVTGFYFDYWGQGTLVTVSS |
| 38 | | DLL3-4 | VL | EIVLTQSPGTLSLSPGERVTLSCRASQRVNNNYLAWYQQRPGQAPRLLIYGASSRATGIPDR FSGSGSGTDFTLTISRLEPEDFAVYYCQQYDRSPLTFGGGTKLEIK |
| 39 | EGF-3 | DLL3-4 | scFv | QVQLQESGPGLVKPSETLSLTCTVSGGSISSYYWSWIRQPPGKGLEWIGYVYYSGTTNYNPS LKSRVTISVDTSKNQFSLKLSSVTAADTAVYYCASIAVTGFYFDYWGQGTLVTVSSGGGGSG GGGSGGGGSEIVLTQSPGTLSLSPGERVTLSCRASQRVNNNYLAWYQQRPGQAPRLLIYGAS SRATGIPDRFSGSGSGTDFTLTISRLEPEDFAVYYCQQYDRSPLTFGGGTKLEIK |
| 40 | | DLL3-4 xI2C | bispecific molecule | QVQLQESGPGLVKPSETLSLTCTVSGGSISSYYWSWIRQPPGKGLEWIGYVYYSGTTNYNPS LKSRVTISVDTSKNQFSLKLSSVTAADTAVYYCASIAVTGFYFDYWGQGTLVTVSSGGGGSG GGGSGGGGSEIVLTQSPGTLSLSPGERVTLSCRASQRVNNNYLAWYQQRPGQAPRLLIYGAS SRATGIPDRFSGSGSGTDFTLTISRLEPEDFAVYYCQQYDRSPLTFGGGTKLEIKSGGGGSE |

TABLE 18-continued

| SEQ ID NO | DLL3-epitope | Designation | Format / Source | Amino acid sequence |
|---|---|---|---|---|
| | | | | VQLVESGGGLVQPGGSLKLSCAASGFTFNKYAMNWVRQAPGKGLEWVARIRSKYNNYATYYA DSVKDRFTISRDDSKNTAYLQMNNLKTEDTAVYYCVRHGNFGNSYISYWAYWGQGTLVTVSS GGGGSGGGGSGGGGSQTVVTQEPSLTVSPGGTVTLTCGSSTGAVTSGNYPNWVQQKPGQAPR GLIGGTKFLAPGTPARFSGSLLGGKAALTLSGVQPEDEAEYYCVLWYSNRWVFGGGTKLTVL |
| 41 | | DLL3-5 | VH CDR1 | SYYWS |
| 42 | | DLL3-5 | VH CDR2 | YIYYSGRTNYYPSLKS |
| 43 | | DLL3-5 | VH CDR3 | IAVAGFFFDY |
| 44 | | DLL3-5 | VL CDR1 | RASQSVNKNYLA |
| 45 | | DLL3-5 | VL CDR2 | GASSRAT |
| 46 | | DLL3-5 | VL CDR3 | QQYDRSPLT |
| 47 | | DLL3-5 | VH | QVQLQESGPGLVKPSETLSLTCTVSGGSISSYYWSWIRQPPGKGLEWIGYIYYSGRTNYYPS LKSRVTISIDTSKNQFSLKLSSVTAADTAVYYCARIAVAGFFFDYWGQGTLVTVSS |
| 48 | | DLL3-5 | VL | EIVLTQSPGTLSLSPGERATLSCRASQSVNKNYLAWYQQKPGQAPRLLIYGASSRATGIPDR FSGSGSGTDFTLTISRLEPEDFAVYYCQQYDRSPLTFGGGTKLEIK |
| 49 | EGF-3 | DLL3-5 | scFv | QVQLQESGPGLVKPSETLSLTCTVSGGSISSYYWSWIRQPPGKGLEWIGYIYYSGRTNYYPS LKSRVTISIDTSKNQFSLKLSSVTAADTAVYYCARIAVAGFFFDYWGQGTLVTVSSGGGGSG GGGSGGGGSEIVLTQSPGTLSLSPGERATLSCRASQSVNKNYLAWYQQKPGQAPRLLIYGAS SRATGIPDRFSGSGSGTDFTLTISRLEPEDFAVYYCQQYDRSPLTFGGGTKLEIK |
| 50 | | DLL3-5 xI2C | bispecific molecule | QVQLQESGPGLVKPSETLSLTCTVSGGSISSYYWSWIRQPPGKGLEWIGYIYYSGRTNYYPS LKSRVTISIDTSKNQFSLKLSSVTAADTAVYYCARIAVAGFFFDYWGQGTLVTVSSGGGGSG GGGSGGGGSEIVLTQSPGTLSLSPGERATLSCRASQSVNKNYLAWYQQKPGQAPRLLIYGAS SRATGIPDRFSGSGSGTDFTLTISRLEPEDFAVYYCQQYDRSPLTFGGGTKLEIKSGGGGSE VQLVESGGGLVQPGGSLKLSCAASGFTFNKYAMNWVRQAPGKGLEWVARIRSKYNNYATYYA DSVKDRFTISRDDSKNTAYLQMNNLKTEDTAVYYCVRHGNFGNSYISYWAYWGQGTLVTVSS GGGGSGGGGSGGGGSQTVVTQEPSLTVSPGGTVTLTCGSSTGAVTSGNYPNWVQQKPGQAPR GLIGGTKFLAPGTPARFSGSLLGGKAALTLSGVQPEDEAEYYCVLWYSNRWVFGGGTKLTVL |
| 51 | | DLL3-6 | VH CDR1 | SFYWS |
| 52 | | DLL3-6 | VH CDR2 | YIYYSGTTNYNPSLKS |
| 53 | | DLL3-6 | VH CDR3 | IAVAGFFFDY |
| 54 | | DLL3-6 | VL CDR1 | RASQSVNKNYLA |
| 55 | | DLL3-6 | VL CDR2 | GASSRAT |
| 56 | | DLL3-6 | VL CDR3 | QQYDRSPLT |
| 57 | | DLL3-6 | VH | QVQLQESGPGLVKPSETLSLTCTVSGASISSFYWSWIRQPPGKGLEWIGYIYYSGTTNYNPS LKSRVTISVDTSKNQFSLKLSSVTAADTAVYYCARIAVAGFFFDYWGQGTLVTVSS |
| 58 | | DLL3-6 | VL | EIVLTQSPGTLSLSPGERATLSCRASQSVNKNYLAWYQQKPGQAPRLLIYGASSRATGIPDR FSGSGSGTDFTLTISRLEPEDFAVYYCQQYDRSPLTFGGGTKVEIK |
| 59 | EGF-3 | DLL3-6 | scFv | QVQLQESGPGLVKPSETLSLTCTVSGASISSFYWSWIRQPPGKGLEWIGYIYYSGTTNYNPS LKSRVTISVDTSKNQFSLKLSSVTAADTAVYYCARIAVAGFFFDYWGQGTLVTVSSGGGGSG GGGSGGGGSEIVLTQSPGTLSLSPGERATLSCRASQSVNKNYLAWYQQKPGQAPRLLIYGAS SRATGIPDRFSGSGSGTDFTLTISRLEPEDFAVYYCQQYDRSPLTFGGGTKVEIK |
| 60 | | DLL3-6 xI2C | bispecific molecule | QVQLQESGPGLVKPSETLSLTCTVSGASISSFYWSWIRQPPGKGLEWIGYIYYSGTTNYNPS LKSRVTISVDTSKNQFSLKLSSVTAADTAVYYCARIAVAGFFFDYWGQGTLVTVSSGGGGSG GGGSGGGGSEIVLTQSPGTLSLSPGERATLSCRASQSVNKNYLAWYQQKPGQAPRLLIYGAS SRATGIPDRFSGSGSGTDFTLTISRLEPEDFAVYYCQQYDRSPLTFGGGTKVEIKSGGGGSE VQLVESGGGLVQPGGSLKLSCAASGFTFNKYAMNWVRQAPGKGLEWVARIRSKYNNYATYYA DSVKDRFTISRDDSKNTAYLQMNNLKTEDTAVYYCVRHGNFGNSYISYWAYWGQGTLVTVSS GGGGSGGGGSGGGGSQTVVTQEPSLTVSPGGTVTLTCGSSTGAVTSGNYPNWVQQKPGQAPR GLIGGTKFLAPGTPARFSGSLLGGKAALTLSGVQPEDEAEYYCVLWYSNRWVFGGGTKLTVL |
| 61 | | DLL3-7 | VH CDR1 | SFYWS |
| 62 | | DLL3-7 | VH CDR2 | YIYYSGTTNYNPSLKS |
| 63 | | DLL3-7 | VH CDR3 | IAVAGFFFDY |
| 64 | | DLL3-7 | VL CDR1 | RASQSVNKNYLA |

TABLE 18-continued

| SEQ ID NO | DLL3-epitope | Designation | Format / Source | Amino acid sequence |
|---|---|---|---|---|
| 65 | | DLL3-7 | VL CDR2 | GASSRAT |
| 66 | | DLL3-7 | VL CDR3 | QQYDRSPLT |
| 67 | | DLL3-7 | VH | QVQLQESGPGLVKPSQTLSLTCTVSGASISSFYWSWIRQPPGKGLEWIGYIYYSGTTNYNPS LKSRVTISVDTSKNQFSLKLSSVTAADTAVYYCARIAVAGFFFDYWGQGTLVTVSS |
| 68 | | DLL3-7 | VL | EIVLTQSPGTLSLSPGERATLSCRASQSVNKNYLAWYQQKPGQAPRLLIYGASSRATGIPDR FSGSGSGTDFTLTISRLEPEDFAVYYCQQYDRSPLTFGGGTKVEIK |
| 69 | EGF-3 | DLL3-7 | scFv | QVQLQESGPGLVKPSQTLSLTCTVSGASISSFYWSWIRQPPGKGLEWIGYIYYSGTTNYNPS LKSRVTISVDTSKNQFSLKLSSVTAADTAVYYCARIAVAGFFFDYWGQGTLVTVSSGGGGSG GGGSGGGGSEIVLTQSPGTLSLSPGERATLSCRASQSVNKNYLAWYQQKPGQAPRLLIYGAS SRATGIPDRFSGSGSGTDFTLTISRLEPEDFAVYYCQQYDRSPLTFGGGTKVEIK |
| 70 | | DLL3-7 xI2C | bispecific molecule | QVQLQESGPGLVKPSQTLSLTCTVSGASISSFYWSWIRQPPGKGLEWIGYIYYSGTTNYNPS LKSRVTISVDTSKNQFSLKLSSVTAADTAVYYCARIAVAGFFFDYWGQGTLVTVSSGGGGSG GGGSGGGGSEIVLTQSPGTLSLSPGERATLSCRASQSVNKNYLAWYQQKPGQAPRLLIYGAS SRATGIPDRFSGSGSGTDFTLTISRLEPEDFAVYYCQQYDRSPLTFGGGTKVEIKSGGGGSE VQLVESGGGLVQPGGSLKLSCAASGFTFNKYAMNWVRQAPGKGLEWVARIRSKYNNYATYYA DSVKDRFTISRDDSKNTAYLQMNNLKTEDTAVYYCVRHGNFGNSYISYWAYWGQGTLVTVSS GGGGSGGGGSGGGGSQTVVTQEPSLTVSPGGTVTLTCGSSTGAVTSGNYPNWVQQKPGQAPR GLIGGTKFLAPGTPARFSGSLLGGKAALTLSGVQPEDEAEYYCVLWYSNRWVFGGGTKLTVL |
| 71 | | DLL3-8 | VH CDR1 | SFYWS |
| 72 | | DLL3-8 | VH CDR2 | YIYYSGTTNYNPSLKS |
| 73 | | DLL3-8 | VH CDR3 | IAVAGFFFDY |
| 74 | | DLL3-8 | VL CDR1 | RASQSVNKNYLA |
| 75 | | DLL3-8 | VL CDR2 | GASSRAT |
| 76 | | DLL3-8 | VL CDR3 | QQYDRSPLT |
| 77 | | DLL3-8 | VH | QVQLQEWGPGLVKPSETLSLTCTVSGASISSFYWSWIRQPPGKGLEWIGYIYYSGTTNYNPS LKSRVTISVDTSKNQLSLKLSSVTAADTAVYYCARIAVAGFFFDYWGQGTLVTVSSK |
| 78 | | DLL3-8 | VL | EIVLTQSPGTLSLSPGERATLSCRASQSVNKNYLAWYQQKPGQAPRLLIYGASSRATGIPDR FSGSGSGTDFTLTISRLEPEDFAVYYCQQYDRSPLTFGGGTKVDIK |
| 79 | EGF-3 | DLL3-8 | scFv | QVQLQEWGPGLVKPSETLSLTCTVSGASISSFYWSWIRQPPGKGLEWIGYIYYSGTTNYNPS LKSRVTISVDTSKNQLSLKLSSVTAADTAVYYCARIAVAGFFFDYWGQGTLVTVSSGGGGSG GGGSGGGGSEIVLTQSPGTLSLSPGERATLSCRASQSVNKNYLAWYQQKPGQAPRLLIYGAS SRATGIPDRFSGSGSGTDFTLTISRLEPEDFAVYYCQQYDRSPLTFGGGTKVDIK |
| 80 | | DLL3-8 xI2C | bispecific molecule | QVQLQEWGPGLVKPSETLSLTCTVSGASISSFYWSWIRQPPGKGLEWIGYIYYSGTTNYNPS LKSRVTISVDTSKNQLSLKLSSVTAADTAVYYCARIAVAGFFFDYWGQGTLVTVSSGGGGSG GGGSGGGGSEIVLTQSPGTLSLSPGERATLSCRASQSVNKNYLAWYQQKPGQAPRLLIYGAS SRATGIPDRFSGSGSGTDFTLTISRLEPEDFAVYYCQQYDRSPLTFGGGTKVDIKSGGGGSE VQLVESGGGLVQPGGSLKLSCAASGFTFNKYAMNWVRQAPGKGLEWVARIRSKYNNYATYYA DSVKDRFTISRDDSKNTAYLQMNNLKTEDTAVYYCVRHGNFGNSYISYWAYWGQGTLVTVSS GGGGSGGGGSGGGGSQTVVTQEPSLTVSPGGTVTLTCGSSTGAVTSGNYPNWVQQKPGQAPR GLIGGTKFLAPGTPARFSGSLLGGKAALTLSGVQPEDEAEYYCVLWYSNRWVFGGGTKLTVL |
| 81 | | DLL3-9 | VH CDR1 | SFYWS |
| 82 | | DLL3-9 | VH CDR2 | YIYYSGTTNYNPSLKS |
| 83 | | DLL3-9 | VH CDR3 | IAVAGFFFDY |
| 84 | | DLL3-9 | VL CDR1 | RASQSVNKNYLA |
| 85 | | DLL3-9 | VL CDR2 | GASSRAT |
| 86 | | DLL3-9 | VL CDR3 | QQYDRSPLT |
| 87 | | DLL3-9 | VH | QVQLQESGPGLVKPSETLSLTCTVSGASISSFYWSWIRQPPGKGLEWIGYIYYSGTTNYNPS LKSRVTISVDTSKNQFSLKLSSVTAADTAVYYCARIAVAGFFFDYWGQGTLVTVSS |
| 88 | | DLL3-9 | VL | EIVLTQSPGTLSLSPGESATLSCRASQSVNKNYLAWYQQKPGQAPRLLIYGASSRATGIPDR FSGSGSGTDFTLTISRLEPEDFAVYYCQQYDRSPLTFGGGTRLEIK |

TABLE 18-continued

| SEQ ID NO | DLL3-epitope | Designation | Format / Source | Amino acid sequence |
|---|---|---|---|---|
| 89 | EGF-3 | DLL3-9 | scFv | QVQLQESGPGLVKPSETLSLTCTVSGASISSFYWSWIRQPPGKGLEWIGYIYYSGTTNYNPS LKSRVTISVDTSKNQFSLKLSSVTAADTAVYYCARIAVAGFFFDYWGQGTLVTVSSGGGGS GGGGSGGGGSEIVLTQSPGTLSLSPGESATLSCRASQSVNKNYLAWYQQKPGQAPRLLIYGAS SRATGIPDRFSGSGSGTDFTLTISRLEPEDFAVYYCQQYDRSPLTFGGGTRLEIK |
| 90 | | DLL3-9 xI2C | bispecific molecule | QVQLQESGPGLVKPSETLSLTCTVSGASISSFYWSWIRQPPGKGLEWIGYIYYSGTTNYNPS LKSRVTISVDTSKNQFSLKLSSVTAADTAVYYCARIAVAGFFFDYWGQGTLVTVSSGGGGS GGGGSGGGGSEIVLTQSPGTLSLSPGESATLSCRASQSVNKNYLAWYQQKPGQAPRLLIYGAS SRATGIPDRFSGSGSGTDFTLTISRLEPEDFAVYYCQQYDRSPLTFGGGTRLEIKSGGGGSE VQLVESGGGLVQPGGSLKLSCAASGFTFNKYAMNWVRQAPGKGLEWVARIRSKYNNYATYYA DSVKDRFTISRDDSKNTAYLQMNNLKTEDTAVYYCVRHGNFGNSYISYWAYWGQGTLVTVSS GGGGSGGGGSGGGGSQTVVTQEPSLTVSPGGTVTLTCGSSTGAVTSGNYPNWVQQKPGQAPR GLIGGTKFLAPGTPARFSGSLLGGKAALTLSGVQPEDEAEYYCVLWYSNRWVFGGGTKLTVL |
| 91 | | DLL3-10 | VH CDR1 | SYYWS |
| 92 | | DLL3-10 | VH CDR2 | YIFYNGITNYNPSLKS |
| 93 | | DLL3-10 | VH CDR3 | IHSGSFSFDY |
| 94 | | DLL3-10 | VL CDR1 | RASQSVSRGYLA |
| 95 | | DLL3-10 | VL CDR2 | GASSRAT |
| 96 | | DLL3-10 | VL CDR3 | QQYDTSPIT |
| 97 | | DLL3-10 | VH | QVQLQESGPGLVKPSQTLSLTCTVSGGSISSYYWSWIRQPPGKGLEWIGYIFYNGITNYNPS LKSRVTISLDTSKNQFSLKLSSVTAADTAKYYCARIHSGSFSFDYWDQGTLVTVSS |
| 98 | | DLL3-10 | VL | EIVMTQSPGTLSLSPGERATLSCRASQSVSRGYLAWYQQKPGQAPRLLIYGASSRATDIPDR FSGSGSGTDFTLTISRLEPEDFAVYYCQQYDTSPITFGQGTKVEIK |
| 99 | EGF-3 | DLL3-10 | scFv | QVQLQESGPGLVKPSQTLSLTCTVSGGSISSYYWSWIRQPPGKGLEWIGYIFYNGITNYNPS LKSRVTISLDTSKNQFSLKLSSVTAADTAKYYCARIHSGSFSFDYWDQGTLVTVSSGGGGSG GGGSGGGGSEIVMTQSPGTLSLSPGERATLSCRASQSVSRGYLAWYQQKPGQAPRLLIYGAS SRATDIPDRFSGSGSGTDFTLTISRLEPEDFAVYYCQQYDTSPITFGQGTKVEIK |
| 100 | | DLL3-10 xI2C | bispecific molecule | QVQLQESGPGLVKPSQTLSLTCTVSGGSISSYYWSWIRQPPGKGLEWIGYIFYNGITNYNPS LKSRVTISLDTSKNQFSLKLSSVTAADTAKYYCARIHSGSFSFDYWDQGTLVTVSSGGGGSG GGGSGGGGSEIVMTQSPGTLSLSPGERATLSCRASQSVSRGYLAWYQQKPGQAPRLLIYGAS SRATDIPDRFSGSGSGTDFTLTISRLEPEDFAVYYCQQYDTSPITFGQGTKVEIKSGGGGSE VQLVESGGGLVQPGGSLKLSCAASGFTFNKYAMNWVRQAPGKGLEWVARIRSKYNNYATYYA DSVKDRFTISRDDSKNTAYLQMNNLKTEDTAVYYCVRHGNFGNSYISYWAYWGQGTLVTVSS GGGGSGGGGSGGGGSQTVVTQEPSLTVSPGGTVTLTCGSSTGAVTSGNYPNWVQQKPGQAPR GLIGGTKFLAPGTPARFSGSLLGGKAALTLSGVQPEDEAEYYCVLWYSNRWVFGGGTKLTVL |
| 101 | | DLL3-11 | VH CDR1 | NAGMS |
| 102 | | DLL3-11 | VH CDR2 | RIKNKIDGGTTDFAAPVKG |
| 103 | | DLL3-11 | VH CDR3 | RGWYGDYFDY |
| 104 | | DLL3-11 | VL CDR1 | RSSQSLLHSNGYNYLD |
| 105 | | DLL3-11 | VL CDR2 | LGSNRAS |
| 106 | | DLL3-11 | VL CDR3 | MQALQTPFT |
| 107 | | DLL3-11 | VH | EVQLVESGGGLVKPGGSLRLSCAASGFIFNNAGMSWVRQAPGKGLEWVGRIKNKIDGGTTDF AAPVKGRFTISRDDSKNTLYLQMNSLKAEDTAVYYCTARGWYGDYFDYWGQGTLVTVSS |
| 108 | | DLL3-11 | VL | DIVMTQTPLSLPVTPGEPASISCRSSQSLLHSNGYNYLDWYLQKPGQSPQLLIYLGSNRASG VPDRFSGSGSGTDFTLKISRVEAEDVGIYYCMQALQTPFTFGPGTKVEIK |
| 109 | EGF-3 | DLL3-11 | scFv | EVQLVESGGGLVKPGGSLRLSCAASGFIFNNAGMSWVRQAPGKGLEWVGRIKNKIDGGTTDF AAPVKGRFTISRDDSKNTLYLQMNSLKAEDTAVYYCTARGWYGDYFDYWGQGTLVTVSSGGG GSGGGGSGGGGSDIVMTQTPLSLPVTPGEPASISCRSSQSLLHSNGYNYLDWYLQKPGQSPQ LLIYLGSNRASGVPDRFSGSGSGTDFTLKISRVEAEDVGIYYCMQALQTPFTFGPGTKVEIK |
| 110 | | DLL3-11 xI2C | bispecific molecule | EVQLVESGGGLVKPGGSLRLSCAASGFIFNNAGMSWVRQAPGKGLEWVGRIKNKIDGGTTDF AAPVKGRFTISRDDSKNTLYLQMNSLKAEDTAVYYCTARGWYGDYFDYWGQGTLVTVSSGGG GSGGGGSGGGGSDIVMTQTPLSLPVTPGEPASISCRSSQSLLHSNGYNYLDWYLQKPGQSPQ LLIYLGSNRASGVPDRFSGSGSGTDFTLKISRVEAEDVGIYYCMQALQTPFTFGPGTKVEIK SGGGGSEVQLVESGGGLVQPGGSLKLSCAASGFTFNKYAMNWVRQAPGKGLEWVARIRSKYN NYATYYADSVKDRFTISRDDSKNTAYLQMNNLKTEDTAVYYCVRHGNFGNSYISYWAYWGQG TLVTVSSGGGGSGGGGSGGGGSQTVVTQEPSLTVSPGGTVTLTCGSSTGAVTSGNYPNWVQQ |

TABLE 18-continued

| SEQ ID NO | DLL3-epitope | Designation | Format / Source | Amino acid sequence |
|---|---|---|---|---|
| | | | | KPGQAPRGLIGGTKFLAPGTPARFSGSLLGGKAALTLSGVQPEDEAEYYCVLWYSNRWVFGGGTKLTVL |
| 111 | | DLL3-12 | VH CDR1 | SYDIH |
| 112 | | DLL3-12 | VH CDR2 | VISSHGSNKNYARSVKG |
| 113 | | DLL3-12 | VH CDR3 | DGYSGNDPFYYYYHGMDV |
| 114 | | DLL3-12 | VL CDR1 | RASQSISSYLN |
| 115 | | DLL3-12 | VL CDR2 | AASSLQS |
| 116 | | DLL3-12 | VL CDR3 | QQSFTTPLT |
| 117 | | DLL3-12 | VH | QVQLVESGGGVVQPGRSLRLSCAASGFSFSSYDIHWVRQAPGKGLEWVAVISSHGSNKNYAR SVKGRFTISRDNSKNTLYLQMNSLKAEDTAVYYCARDGYSGNDPFYYYYHGMDVWGQGTTVT VSS |
| 118 | | DLL3-12 | VL | DIQMTQSPSSLSASVGDRVTITCRASQSISSYLNWYQQKPGKAPKLLIYAASSLQSGVPSRF SGSGSGTDFSLTISSLQPEDFATYYCQQSFTTPLTFGGGTKVEIK |
| 119 | EGF-3/[4] | DLL3-12 | scFv | QVQLVESGGGVVQPGRSLRLSCAASGFSFSSYDIHWVRQAPGKGLEWVAVISSHGSNKNYAR SVKGRFTISRDNSKNTLYLQMNSLKAEDTAVYYCARDGYSGNDPFYYYYHGMDVWGQGTTVT VSSGGGGSGGGGSGGGGSDIQMTQSPSSLSASVGDRVTITCRASQSISSYLNWYQQKPGKAP KLLIYAASSLQSGVPSRFSGSGSGTDFSLTISSLQPEDFATYYCQQSFTTPLTFGGGTKVEI K |
| 120 | | DLL3-12 xI2C | bispecific molecule | QVQLVESGGGVVQPGRSLRLSCAASGFSFSSYDIHWVRQAPGKGLEWVAVISSHGSNKNYAR SVKGRFTISRDNSKNTLYLQMNSLKAEDTAVYYCARDGYSGNDPFYYYYHGMDVWGQGTTVT VSSGGGGSGGGGSGGGGSDIQMTQSPSSLSASVGDRVTITCRASQSISSYLNWYQQKPGKAP KLLIYAASSLQSGVPSRFSGSGSGTDFSLTISSLQPEDFATYYCQQSFTTPLTFGGGTKVEI KSGGGGSEVQLVESGGGLVQPGGSLKLSCAASGFTFNKYAMNWVRQAPGKGLEWVARIRSKY NNYATYYADSVKDRFTISRDDSKNTAYLQMNNLKTEDTAVYYCVRHGNFGNSYISYWAYWGQ GTLVTVSSGGGGSGGGGSGGGGSQTVVTQEPSLTVSPGGTVTLTCGSSTGAVTSGNYPNWVQ QKPGQAPRGLIGGTKFLAPGTPARFSGSLLGGKAALTLSGVQPEDEAEYYCVLWYSNRWVFG GGTKLTVL |
| 121 | | DLL3-13 | VH CDR1 | SYYMH |
| 122 | | DLL3-13 | VH CDR2 | IINPSDGSTNYAQNFQG |
| 123 | | DLL3-13 | VH CDR3 | GGNSAFYSYYDMDV |
| 124 | | DLL3-13 | VL CDR1 | RSSQSLVYRDGNTYLS |
| 125 | | DLL3-13 | VL CDR2 | KVSNWQS |
| 126 | | DLL3-13 | VL CDR3 | MQGTHWPPT |
| 127 | | DLL3-13 | VH | QVQLVQSGAEVKKPGASVKVSCKASGYTFTSYYMHWVRQAPGQGLEWMGIINPSDGSTNYAQ NFQGRVTMTRDTSTNTVYMELSSLRSEDTAVYYCARGGNSAFYSYYDMDVWGQGTTVTVSS |
| 128 | | DLL3-13 | VL | DVVMTQSPLSLPVTLGQPASISCRSSQSLVYRDGNTYLSWFQQRPGQSPRRLIYKVSNWQSG VPDRFSGSGSGTDFTLKISRVEAEDVGVYFCMQGTHWPPTFGQGTKVEIK |
| 129 | EGF-4 | DLL3-13 | scFv | QVQLVQSGAEVKKPGASVKVSCKASGYTFTSYYMHWVRQAPGQGLEWMGIINPSDGSTNYAQ NFQGRVTMTRDTSTNTVYMELSSLRSEDTAVYYCARGGNSAFYSYYDMDVWGQGTTVTVSSG GGGSGGGGSDVVMTQSPLSLPVTLGQPASISCRSSQSLVYRDGNTYLSWFQQRPGQS PRRLIYKVSNWQSGVPDRFSGSGSGTDFTLKISRVEAEDVGVYFCMQGTHWPPTFGQGTKVE IK |
| 130 | | DLL3-13 xI2C | bispecific molecule | QVQLVQSGAEVKKPGASVKVSCKASGYTFTSYYMHWVRQAPGQGLEWMGIINPSDGSTNYAQ NFQGRVTMTRDTSTNTVYMELSSLRSEDTAVYYCARGGNSAFYSYYDMDVWGQGTTVTVSSG GGGSGGGGSGGGGSDVVMTQSPLSLPVTLGQPASISCRSSQSLVYRDGNTYLSWFQQRPGQS PRRLIYKVSNWQSGVPDRFSGSGSGTDFTLKISRVEAEDVGVYFCMQGTHWPPTFGQGTKVE IKSGGGGSEVQLVESGGGLVQPGGSLKLSCAASGFTFNKYAMNWVRQAPGKGLEWVARIRSK YNNYATYYADSVKDRFTISRDDSKNTAYLQMNNLKTEDTAVYYCVRHGNFGNSYISYWAYWG QGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVF GGGTKLTVL |
| 131 | | DLL3-14 | VH CDR1 | NYYMH |
| 132 | | DLL3-14 | VH CDR2 | IINPSDGSTSYAQKFQG |

TABLE 18-continued

| SEQ ID NO | DLL3-epitope | Designation | Format / Source | Amino acid sequence |
|---|---|---|---|---|
| 133 | | DLL3-14 | VH CDR3 | GGNSAFYSYYDMDV |
| 134 | | DLL3-14 | VL CDR1 | RSSQSLVYRDGNTYLS |
| 135 | | DLL3-14 | VL CDR2 | KVSNWQS |
| 136 | | DLL3-14 | VL CDR3 | MQGTHWPPT |
| 137 | | DLL3-14 | VH | QVQLVQSGAEVKKPGASVKVSCKASGYTFTNYYMHWVRQAPGLGLEWMGIINPSDGSTSYAQKFQGRVTMTRDTSTNTVYMDLSSLRSEDTAVYYCARGGNSAFYSYYDMDVWGQGTTVTVSS |
| 138 | | DLL3-14 | VL | DVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGQGTKVEIK |
| 139 | EGF-4 | DLL3-14 | scFv | QVQLVQSGAEVKKPGASVKVSCKASGYTFTNYYMHWVRQAPGLGLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGQGTKVEIK |
| 140 | | DLL3-14 x12C | bispecific molecule | QVQLVQSGAEVKKPGASVKVSCKASGYTFTNYYMHWVRQAPGLGLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 141 | | DLL3-15 | VH CDR1 | GYYIH |
| 142 | | DLL3-15 | VH CDR2 | IINPSDGSTSYGQNFQG |
| 143 | | DLL3-15 | VH CDR3 | GGNSAFYSYYDMDV |
| 144 | | DLL3-15 | VL CDR1 | RSSQSLAYRDGNTYLS |
| 145 | | DLL3-15 | VL CDR2 | KVSNWQS |
| 146 | | DLL3-15 | VL CDR3 | MQGTHWPPT |
| 147 | | DLL3-15 | VH | QVQLVQSGAEVKKPGASVKVSCKASGYTFTGYYIHWVRQAPGQGLEWMGIINPSDGSTSYGQNFQGRVTMTRDTSTNTVYMELSSLRSEDTAVYYCARGGNSAFYSYYDMDVWGQGTTVTVSS |
| 148 | | DLL3-15 | VL | DVVMTQSPLSLPVTLGQPASISCRSSQSLAYRDGNTYLSWFQQRPGQSPRRLIYKVSNWQSGVPDRFSGSGSGTDFTLKISRVEAEDVGVYFCMQGTHWPPTFGQGTKVEIK |
| 149 | EGF-4 | DLL3-15 | scFv | QVQLVQSGAEVKKPGASVKVSCKASGYTFTGYYIHWVRQAPGQGLEWMGIINPSDGSTSYGQNFQGRVTMTRDTSTNTVYMELSSLRSEDTAVYYCARGGNSAFYSYYDMDVWGQGTTVTVSSGGGGSGGGGSGGGGSDVVMTQSPLSLPVTLGQPASISCRSSQSLAYRDGNTYLSWFQQRPGQSPRRLIYKVSNWQSGVPDRFSGSGSGTDFTLKISRVEAEDVGVYFCMQGTHWPPTFGQGTKVEIK |
| 150 | | DLL3-15 x12C | bispecific molecule | QVQLVQSGAEVKKPGASVKVSCKASGYTFTGYYIHWVRQAPGQGLEWMGIINPSDGSTSYGQNFQGRVTMTRDTSTNTVYMELSSLRSEDTAVYYCARGGNSAFYSYYDMDVWGQGTTVTVSSGGGGSGGGGSGGGGSDVVMTQSPLSLPVTLGQPASISCRSSQSLAYRDGNTYLSWFQQRPGQSPRRLIYKVSNWQSGVPDRFSGSGSGTDFTLKISRVEAEDVGVYFCMQGTHWPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 151 | | DLL3-16 | VH CDR1 | GHYMH |
| 152 | | DLL3-16 | VH CDR2 | IINPSDGSTNYAQKFQG |
| 153 | | DLL3-16 | VH CDR3 | GTTVVHYSYYDMDV |
| 154 | | DLL3-16 | VL CDR1 | RSSQSLVYRDGNTYLT |
| 155 | | DLL3-16 | VL CDR2 | KVSNWQS |
| 156 | | DLL3-16 | VL CDR3 | MQGTHWPPT |

TABLE 18-continued

| SEQ ID NO | DLL3-epitope | Designation | Format / Source | Amino acid sequence |
|---|---|---|---|---|
| 157 | | DLL3-16 | VH | QVQLVQSGAEVKKPGASVKVSCKASGYTFTGHYMHWVRQAPGQGLEWMGIINPSDGSTNYAQKFQGRVTMTRDTSTSTVYMELRSLRSEDTAVYYCTRGTTVVHYSYYDMDVWGQGTTVTVSS |
| 158 | | DLL3-16 | VL | DVVMTQTPLSLPVTLGQPASISCRSSQSLVYRDGNTYLTWFQQRPGQSPRRLIYKVSNWQSGVPDRFSGSGSGTDFTLKISRVEAEDVGVYYCMQGTHWPPTFGGGTKVEIK |
| 159 | EGF-4 | DLL3-16 | scFv | QVQLVQSGAEVKKPGASVKVSCKASGYTFTGHYMHWVRQAPGQGLEWMGIINPSDGSTNYAQKFQGRVTMTRDTSTSTVYMELRSLRSEDTAVYYCTRGTTVVHYSYYDMDVWGQGTTVTVSSGGGSGGGGSGGGGSDVVMTQTPLSLPVTLGQPASISCRSSQSLVYRDGNTYLTWFQQRPGQSPRRLIYKVSNWQSGVPDRFSGSGSGTDFTLKISRVEAEDVGVYYCMQGTHWPPTFGGGTKVEIK |
| 160 | | DLL3-16 xI2C | bispecific molecule | QVQLVQSGAEVKKPGASVKVSCKASGYTFTGHYMHWVRQAPGQGLEWMGIINPSDGSTNYAQKFQGRVTMTRDTSTSTVYMELRSLRSEDTAVYYCTRGTTVVHYSYYDMDVWGQGTTVTVSSGGGSGGGGSGGGGSDVVMTQTPLSLPVTLGQPASISCRSSQSLVYRDGNTYLTWFQQRPGQSPRRLIYKVSNWQSGVPDRFSGSGSGTDFTLKISRVEAEDVGVYYCMQGTHWPPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 161 | | DLL3-17 | VH CDR1 | NYFMH |
| 162 | | DLL3-17 | VH CDR2 | IINPSDGSTSYAQNFQG |
| 163 | | DLL3-17 | VH CDR3 | GGNSAFYSYYDMDV |
| 164 | | DLL3-17 | VL CDR1 | RSSQSLVYRDGNTYLS |
| 165 | | DLL3-17 | VL CDR2 | RVSNWQS |
| 166 | | DLL3-17 | VL CDR3 | MQGTYWPPT |
| 167 | | DLL3-17 | VH | QVQLVQSGAEVKKPGASVKVSCKASGYTFTNYFMHWVRQAPGLGLEWMGIINPSDGSTSYAQNFQGRVTMTRDTSTNTVYMELSSLRSEDTAVYYCARGGNSAFYSYYDMDVWGQGTTVTVSS |
| 168 | | DLL3-17 | VL | DVVMTQSPLSLPVTLGQPASISCRSSQSLVYRDGNTYLSWFQQRPGQSPRRLIYRVSNWQSGVPDRFSGSGSGTDFTLKISRVEAEDVGVYFCMQGTYWPPTFGQGTKVDIK |
| 169 | EGF-4 | DLL3-17 | scFv | QVQLVQSGAEVKKPGASVKVSCKASGYTFTNYFMHWVRQAPGLGLEWMGIINPSDGSTSYAQNFQGRVTMTRDTSTNTVYMELSSLRSEDTAVYYCARGGNSAFYSYYDMDVWGQGTTVTVSSGGGSGGGGSGGGGSDVVMTQSPLSLPVTLGQPASISCRSSQSLVYRDGNTYLSWFQQRPGQSPRRLIYRVSNWQSGVPDRFSGSGSGTDFTLKISRVEAEDVGVYFCMQGTYWPPTFGQGTKVDIK |
| 170 | | DLL3-17 xI2C | bispecific molecule | QVQLVQSGAEVKKPGASVKVSCKASGYTFTNYFMHWVRQAPGLGLEWMGIINPSDGSTSYAQNFQGRVTMTRDTSTNTVYMELSSLRSEDTAVYYCARGGNSAFYSYYDMDVWGQGTTVTVSSGGGSGGGGSGGGGSDVVMTQSPLSLPVTLGQPASISCRSSQSLVYRDGNTYLSWFQQRPGQSPRRLIYRVSNWQSGVPDRFSGSGSGTDFTLKISRVEAEDVGVYFCMQGTYWPPTFGQGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 171 | | DLL3-18 | VH CDR1 | NYGMH |
| 172 | | DLL3-18 | VH CDR2 | VISHHGSSKYYARSVKG |
| 173 | | DLL3-18 | VH CDR3 | DWWELVFDY |
| 174 | | DLL3-18 | VL CDR1 | KSSQSLLHSDGKTFLY |
| 175 | | DLL3-18 | VL CDR2 | EVSNRFS |
| 176 | | DLL3-18 | VL CDR3 | LQGIHLPFT |
| 177 | | DLL3-18 | VH | QVQLVESGGGAVQPGRSLRLSCAASGFTFSNYGMHWVRQAPGKGLEWVAVISHHGSSKYYARSVKGRFTISRDNSKNTLYLEMNSLRAEDTAVYYCARDWWELVFDYWGQGTLVTVSS |
| 178 | | DLL3-18 | VL | DIVMTQTPLSLSVTPGQPASISCKSSQSLLHSDGKTFLYWYLQKPGQPPQLLIYEVSNRFSGVPDRFSGSGSGTDFTLKISRVEAEDVGVYYCLQGIHLPFTFGPGTKVEIK |
| 179 | EGF-5/[6] | DLL3-18 | scFv | QVQLVESGGGAVQPGRSLRLSCAASGFTFSNYGMHWVRQAPGKGLEWVAVISHHGSSKYYARSVKGRFTISRDNSKNTLYLEMNSLRAEDTAVYYCARDWWELVFDYWGQGTLVTVSSGGGGSG |

TABLE 18-continued

| SEQ ID NO | DLL3-epitope | Designation | Format / Source | Amino acid sequence |
|---|---|---|---|---|
| | | | | GGGSGGGGSDIVMTQTPLSLSVTPGQPASISCKSSQSLLHSDGKTFLYWYLQKPGQPPQLLI YEVSNRFSGVPDRFSGSGSGTDFTLKISRVEAEDVGVYYCLQGIHLPFTFGPGTKVEIK |
| 180 | | DLL3-18 x12C | bispecific molecule | QVQLVESGGGAVQPGRSLRLSCAASGFTFSNYGMHWVRQAPGKGLEWVAVISHHGSSKYYAR SVKGRFTISRDNSKNTLYLEMNSLRAEDTAVYYCARDWWELVFDYWGQGTLVTVSSGGGGS GGGSGGGGSDIVMTQTPLSLSVTPGQPASISCKSSQSLLHSDGKTFLYWYLQKPGQPPQLLI YEVSNRFSGVPDRFSGSGSGTDFTLKISRVEAEDVGVYYCLQGIHLPFTFGPGTKVEIKSGG GGSEVQLVESGGGLVQPGGSLKLSCAASGFTFNKYAMNWVRQAPGKGLEWVARIRSKYNNYA TYYADSVKDRFTISRDDSKNTAYLQMNNLKTEDTAVYYCVRHGNFGNSYISYWAYWGQGTLV TVSSGGGGSGGGGSGGGGSQTVVTQEPSLTVSPGGTVTLTCGSSTGAVTSGNYPNWVQQKPG QAPRGLIGGTKFLAPGTPARFSGSLLGGKAALTLSGVQPEDEAEYYCVLWYSNRWVFGGGTK LTVL |
| 181 | | DLL3-19 | VH CDR1 | NSRMGVS |
| 182 | | DLL3-19 | VH CDR2 | HIFSNDGKSYSTSLKS |
| 183 | | DLL3-19 | VH CDR3 | YNYDSSGYYYSFFDY |
| 184 | | DLL3-19 | VL CDR1 | RASQSISSYLN |
| 185 | | DLL3-19 | VL CDR2 | AASSLQS |
| 186 | | DLL3-19 | VL CDR3 | QQGYSSPFT |
| 187 | | DLL3-19 | VH | QVTLKESGPMLVKPTETLTLTCTVSGFSLSNSRMGVSWIRQPPGRALEWLAHIFSNDGKSYS TSLKSRLTISKDTSKSQVVLTMTNMDPVDTATYYCARYNYDSSGYYYSFFDYWGQGTLVTVS S |
| 188 | | DLL3-19 | VL | DIQMTQSPSSLSASVGDRVTITCRASQSISSYLNWYQQKPGKAPKLLIYAASSLQSGVPSRF SGSGSGTDFTLTISSLQPEDFATYYCQQGYSSPFTFGGGTKVEIK |
| 189 | EGF-5/[6] | DLL3-19 | scFv | QVTLKESGPMLVKPTETLTLTCTVSGFSLSNSRMGVSWIRQPPGRALEWLAHIFSNDGKSYS TSLKSRLTISKDTSKSQVVLTMTNMDPVDTATYYCARYNYDSSGYYYSFFDYWGQGTLVTVS SGGGGSGGGGSGGGGSDIQMTQSPSSLSASVGDRVTITCRASQSISSYLNWYQQKPGKAPKL LIYAASSLQSGVPSRFSGSGSGTDFTLTISSLQPEDFATYYCQQGYSSPFTFGGGTKVEIK |
| 190 | | DLL3-19 x12C | bispecific molecule | QVTLKESGPMLVKPTETLTLTCTVSGFSLSNSRMGVSWIRQPPGRALEWLAHIFSNDGKSYS TSLKSRLTISKDTSKSQVVLTMTNMDPVDTATYYCARYNYDSSGYYYSFFDYWGQGTLVTVS SGGGGSGGGGSGGGGSDIQMTQSPSSLSASVGDRVTITCRASQSISSYLNWYQQKPGKAPKL LIYAASSLQSGVPSRFSGSGSGTDFTLTISSLQPEDFATYYCQQGYSSPFTFGGGTKVEIKS GGGGSEVQLVESGGGLVQPGGSLKLSCAASGFTFNKYAMNWVRQAPGKGLEWVARIRSKYNN YATYYADSVKDRFTISRDDSKNTAYLQMNNLKTEDTAVYYCVRHGNFGNSYISYWAYWGQGT LVTVSSGGGGSGGGGSGGGGSQTVVTQEPSLTVSPGGTVTLTCGSSTGAVTSGNYPNWVQQK PGQAPRGLIGGTKFLAPGTPARFSGSLLGGKAALTLSGVQPEDEAEYYCVLWYSNRWVFGGG TKLTVL |
| 191 | | DLL3-20 | VH CDR1 | NARMGVS |
| 192 | | DLL3-20 | VH CDR2 | HIFSTDEKSYSTSLKS |
| 193 | | DLL3-20 | VH CDR3 | YYYDSSGYYYSFFDY |
| 194 | | DLL3-20 | VL CDR1 | RASQSIRSYLN |
| 195 | | DLL3-20 | VL CDR2 | GASNLQS |
| 196 | | DLL3-20 | VL CDR3 | QQSYSSPFT |
| 197 | | DLL3-20 | VH | QVTLKESGPVLVKPTETLTLTCTVSGFSLSNARMGVSWLRQPPGKALEWLAHIFSTDEKSYS TSLKSRLTISKDTSKSQVVLTMTNMDPVDTATYYCARYYYDSSGYYYSFFDYWGQGTLVTVS S |
| 198 | | DLL3-20 | VL | DIQMTQSPSSLSASVGDRVTITCRASQSIRSYLNWYQQKPGKAPKLLIYGASNLQSGVPSRF SGSGSGTDFTLTISSLQPEDFATYYCQQSYSSPFTFGGGTKVEIK |
| 199 | EGF-5/[6] | DLL3-20 | scFv | QVTLKESGPVLVKPTETLTLTCTVSGFSLSNARMGVSWLRQPPGKALEWLAHIFSTDEKSYS TSLKSRLTISKDTSKSQVVLTMTNMDPVDTATYYCARYYYDSSGYYYSFFDYWGQGTLVTVS SGGGGSGGGGSGGGGSDIQMTQSPSSLSASVGDRVTITCRASQSIRSYLNWYQQKPGKAPKL LIYGASNLQSGVPSRFSGSGSGTDFTLTISSLQPEDFATYYCQQSYSSPFTFGGGTKVEIK |
| 200 | | DLL3-20 x12C | bispecific molecule | QVTLKESGPVLVKPTETLTLTCTVSGFSLSNARMGVSWLRQPPGKALEWLAHIFSTDEKSYS TSLKSRLTISKDTSKSQVVLTMTNMDPVDTATYYCARYYYDSSGYYYSFFDYWGQGTLVTVS SGGGGSGGGGSGGGGSDIQMTQSPSSLSASVGDRVTITCRASQSIRSYLNWYQQKPGKAPKL LIYGASNLQSGVPSRFSGSGSGTDFTLTISSLQPEDFATYYCQQSYSSPFTFGGGTKVEIKS GGGGSEVQLVESGGGLVQPGGSLKLSCAASGFTFNKYAMNWVRQAPGKGLEWVARIRSKYNN |

TABLE 18-continued

| SEQ ID NO | DLL3-epitope | Designation | Format / Source | Amino acid sequence |
|---|---|---|---|---|
| | | | | YATYYADSVKDRFTISRDDSKNTAYLQMNNLKTEDTAVYYCVRHGNFGNSYISYWAYWGQGT LVTVSSGGGGSGGGGSGGGGSQTVVTQEPSLTVSPGGTVTLTCGSSTGAVTSGNYPNWVQQK PGQAPRGLIGGTKFLAPGTPARFSGSLLGGKAALTLSGVQPEDEAEYYCVLWYSNRWVFGGG TKLTVL |
| 201 | | DLL3-21 | VH CDR1 | SYYIH |
| 202 | | DLL3-21 | VH CDR2 | IINPSGGSKSYAQKFRG |
| 203 | | DLL3-21 | VH CDR3 | SMSTVTSDAFDI |
| 204 | | DLL3-21 | VL CDR1 | RASQSISNYLN |
| 205 | | DLL3-21 | VL CDR2 | AASSLQS |
| 206 | | DLL3-21 | VL CDR3 | QQSYSAPLT |
| 207 | | DLL3-21 | VH | QVQLVQSGAEVKKPGASVKVSCKASGYAFTSYYIHWVRQAPGQGLEWMGIINPSGGSKSYAQ KFRGRVTMTRDTSTSTVYMELSSLTSEDTAVYYCARSMSTVTSDAFDIWGQGTMVTVSS |
| 208 | | DLL3-21 | VL | DIQMTQSPSSLSASVGDRVTITCRASQSISNYLNWYQQKPGKAPKLLIYAASSLQSGVPSRF SGSGSGTEFTLTISSLQPEDFATYYCQQSYSAPLTFGGGTKVDIK |
| 209 | EGF-5/[6] | DLL3-21 | scFv | QVQLVQSGAEVKKPGASVKVSCKASGYAFTSYYIHWVRQAPGQGLEWMGIINPSGGSKSYAQ KFRGRVTMTRDTSTSTVYMELSSLTSEDTAVYYCARSMSTVTSDAFDIWGQGTMVTVSSGGG GSGGGGSGGGGSDIQMTQSPSSLSASVGDRVTITCRASQSISNYLNWYQQKPGKAPKLLIYA ASSLQSGVPSRFSGSGSGTEFTLTISSLQPEDFATYYCQQSYSAPLTFGGGTKVDIK |
| 210 | | DLL3-21 xI2C | bispecific molecule | QVQLVQSGAEVKKPGASVKVSCKASGYAFTSYYIHWVRQAPGQGLEWMGIINPSGGSKSYAQ KFRGRVTMTRDTSTSTVYMELSSLTSEDTAVYYCARSMSTVTSDAFDIWGQGTMVTVSSGGG GSGGGGSGGGGSDIQMTQSPSSLSASVGDRVTITCRASQSISNYLNWYQQKPGKAPKLLIYA ASSLQSGVPSRFSGSGSGTEFTLTISSLQPEDFATYYCQQSYSAPLTFGGGTKVDIKSGGGG SEVQLVESGGGLVQPGGSLKLSCAASGFTFNKYAMNWVRQAPGKGLEWVARIRSKYNNYATY YADSVKDRFTISRDDSKNTAYLQMNNLKTEDTAVYYCVRHGNFGNSYISYWAYWGQGTLVTV SSGGGGSGGGGSGGGGSQTVVTQEPSLTVSPGGTVTLTCGSSTGAVTSGNYPNWVQQKPGQA PRGLIGGTKFLAPGTPARFSGSLLGGKAALTLSGVQPEDEAEYYCVLWYSNRWVFGGGKLT VL |
| 211 | EGF-3 | DLL3-4 xF12Q | bispecific molecule | QVQLQESGPGLVKPSETLSLTCTVSGGSISSYYWSWIRQPPGKGLEWIGYVYYSGTTNYNPS LKSRVTISVDTSKNQFSLKLSSVTAADTAVYYCASIAVTGFYFDYWGQGTLVTVSSGGGGSG GGGSGGGGSEIVLTQSPGTLSLSPGERVTLSCRASQRVNNNYLAWYQQRPGQAPRLLIYGAS SRATGIPDRFSGSGSGTDFTLTISRLEPEDFAVYYCQQYDRSPLTFGGGTKLEIKSGGGGSE VQLVESGGGLVQPGGSLRLSCAASGFTFNSYAMNWVRQAPGKGLEWVARIRSKYNNYATYYA DSVKGRFTISRDDSKNTAYLQMNSLKTEDTAVYYCVRHGNFGNSYVSWWAYWGQGTLVTVSS GGGGSGGGGSGGGGSQTVVTQEPSLTVSPGGTVTLTCGSSTGAVTSGNYPNWVQQKPGQAPR GLIGGTKFLAPGTPARFSGSLLGGKAALTLSGVQPEDEAEYYCVLWYSNRWVFGGGTKLTVL |
| 212 | EGF-3 | DLL3-5 xF12Q | bispecific molecule | QVQLQESGPGLVKPSETLSLTCTVSGGSISSYYWSWIRQPPGKGLEWIGYIYYSGRTNYYPS LKSRVTISIDTSKNQFSLKLSSVTAADTAVYYCARIAVAGFFFDYWGQGTLVTVSSGGGGSG GGGSGGGGSEIVLTQSPGTLSLSPGERATLSCRASQSVNKNYLAWYQQKPGQAPRLLIYGAS SRATGIPDRFSGSGSGTDFTLTISRLEPEDFAVYYCQQYDRSPLTFGGGTKLEIKSGGGGSE VQLVESGGGLVQPGGSLRLSCAASGFTFNSYAMNWVRQAPGKGLEWVARIRSKYNNYATYYA DSVKGRFTISRDDSKNTAYLQMNSLKTEDTAVYYCVRHGNFGNSYVSWWAYWGQGTLVTVSS GGGGSGGGGSGGGGSQTVVTQEPSLTVSPGGTVTLTCGSSTGAVTSGNYPNWVQQKPGQAPR GLIGGTKFLAPGTPARFSGSLLGGKAALTLSGVQPEDEAEYYCVLWYSNRWVFGGGTKLTVL |
| 213 | EGF-3 | DLL3-6 xF12Q | bispecific molecule | QVQLQESGPGLVKPSETLSLTCTVSGASISSYYWSWIRQPPGKGLEWIGYIYYSGTTNYNPS LKSRVTISVDTSKNQFSLKLSSVTAADTAVYYCARIAVAGFFFDYWGQGTLVTVSSGGGGSG GGGSGGGGSEIVLTQSPGTLSLSPGERATLSCRASQSVNKNYLAWYQQKPGQAPRLLIYGAS SRATGIPDRFSGSGSGTDFTLTISRLEPEDFAVYYCQQYDRSPLTFGGGTKVEIKSGGGGSE VQLVESGGGLVQPGGSLRLSCAASGFTFNSYAMNWVRQAPGKGLEWVARIRSKYNNYATYYA DSVKGRFTISRDDSKNTAYLQMNSLKTEDTAVYYCVRHGNFGNSYVSWWAYWGQGTLVTVSS GGGGSGGGGSGGGGSQTVVTQEPSLTVSPGGTVTLTCGSSTGAVTSGNYPNWVQQKPGQAPR GLIGGTKFLAPGTPARFSGSLLGGKAALTLSGVQPEDEAEYYCVLWYSNRWVFGGGTKLTVL |
| 214 | EGF-3 | DLL3-7 xF12Q | bispecific molecule | QVQLQESGPGLVKPSQTLSLTCTVSGASISSFYWSWIRQPPGKGLEWIGYIYYSGTTNYNPS LKSRVTISVDTSKNQFSLKLSSVTAADTAVYYCARIAVAGFFFDYWGQGTLVTVSSGGGGSG GGGSGGGGSEIVLTQSPGTLSLSPGERATLSCRASQSVNKNYLAWYQQKPGQAPRLLIYGAS SRATGIPDRFSGSGSGTDFTLTISRLEPEDFAVYYCQQYDRSPLTFGGGTKVEIKSGGGGSE VQLVESGGGLVQPGGSLRLSCAASGFTFNSYAMNWVRQAPGKGLEWVARIRSKYNNYATYYA DSVKGRFTISRDDSKNTAYLQMNSLKTEDTAVYYCVRHGNFGNSYVSWWAYWGQGTLVTVSS GGGGSGGGGSGGGGSQTVVTQEPSLTVSPGGTVTLTCGSSTGAVTSGNYPNWVQQKPGQAPR GLIGGTKFLAPGTPARFSGSLLGGKAALTLSGVQPEDEAEYYCVLWYSNRWVFGGGTKLTVL |
| 215 | EGF-3 | DLL3-8 xF12Q | bispecific molecule | QVQLQEWGPGLVKPSETLSLTCTVSGASISSFYWSWIRQPPGKGLEWIGYIYYSGTTNYNPS LKSRVTISVDTSKNQLSLKLSSVTAADTAVYYCARIAVAGFFFDYWGQGTLVTVSSGGGGSG |

TABLE 18-continued

| SEQ ID NO | DLL3-epitope | Designation | Format / Source | Amino acid sequence |
|---|---|---|---|---|
| | | | | GGGSGGGGSEIVLTQSPGTLSLSPGERATLSCRASQSVNKNYLAWYQQKPGQAPRLLIYGAS SRATGIPDRFSGSGSGTDFTLTISRLEPEDFAVYYCQQYDRSPLTFGGGTKVDIKSGGGGSE VQLVESGGGLVQPGGSLRLSCAASGFTFNSYAMNWVRQAPGKGLEWVARIRSKYNNYATYYA DSVKGRFTISRDDSKNTAYLQMNSLKTEDTAVYYCVRHGNFGNSYVSWWAYWGQGTLVTVSS GGGSGGGGSGGGGSQTVVTQEPSLTVSPGGTVTLTCGSSTGAVTSGNYPNWVQQKPGQAPR GLIGGTKFLAPGTPARFSGSLLGGKAALTLSGVQPEDEAEYYCVLWYSNRWVFGGGTKLTVL |
| 216 | EGF-3 | DLL3-9 xF12Q | bispecific molecule | QVQLQESGPGLVKPSETLSLTCTVSGASISSFYWSWIRQPPGKGLEWIGYIYYSGTTNYNPS LKSRVTISVDTSKNQFSLKLSSVTAADTAVYYCARIAVAGFFFDYWGQGTLVTVSSGGGGSG GGGSGGGGSEIVLTQSPGTLSLSPGESATLSCRASQSVNKNYLAWYQQKPGQAPRLLIYGAS SRATGIPDRFSGSGSGTDFTLTISRLEPEDFAVYYCQQYDRSPLTFGGGTRLEIKSGGGGSE VQLVESGGGLVQPGGSLRLSCAASGFTFNSYAMNWVRQAPGKGLEWVARIRSKYNNYATYYA DSVKGRFTISRDDSKNTAYLQMNSLKTEDTAVYYCVRHGNFGNSYVSWWAYWGQGTLVTVSS GGGGSGGGGSGGGGSQTVVTQEPSLTVSPGGTVTLTCGSSTGAVTSGNYPNWVQQKPGQAPR GLIGGTKFLAPGTPARFSGSLLGGKAALTLSGVQPEDEAEYYCVLWYSNRWVFGGGTKLTVL |
| 217 | EGF-3 | DLL3-10 xF12Q | bispecific molecule | QVQLQESGPGLVKPSQTLSLTCTVSGGSISSYYWSWIRQPPGKGLEWIGYIFYNGITNYNPS LKSRVTISLDTSKNQFSLKLSSVTAADTAKYYCARIHSGSFSFDYWDQGTLVTVSSGGGGSG GGGSGGGGSEIVMTQSPGTLSLSPGERATLSCRASQSVSRGYLAWYQQKPGQAPRLLIYGAS SRATDIPDRFSGSGSGTDFTLTISRLEPEDFAVYYCQQYDTSPITFGQGTKVEIKSGGGGSE VQLVESGGGLVQPGGSLRLSCAASGFTFNSYAMNWVRQAPGKGLEWVARIRSKYNNYATYYA DSVKGRFTISRDDSKNTAYLQMNSLKTEDTAVYYCVRHGNFGNSYVSWWAYWGQGTLVTVSS GGGGSGGGGSGGGGSQTVVTQEPSLTVSPGGTVTLTCGSSTGAVTSGNYPNWVQQKPGQAPR GLIGGTKFLAPGTPARFSGSLLGGKAALTLSGVQPEDEAEYYCVLWYSNRWVFGGGTKLTVL |
| 218 | EGF-4 | DLL3-13 xF12Q | bispecific molecule | QVQLVQSGAEVKKPGASVKVSCKASGYTFTSYYMHWVRQAPGQGLEWMGIINPSDGSTNYAQ NFQGRVTMTRDTSTNTVYMELSSLRSEDTAVYYCARGGNSAFYSYYDMDVWGQGTTVTVSSG GGGSGGGGSGGGGSDVVMTQSPLSLPVTLGQPASISCRSSQSLVYRDGNTYLSWFQQRPGQS PRRLIYKVSNWQSGVPDRFSGSGSGTDFTLKISRVEAEDVGVYFCMQGTHWPPTFGQGTKVE IKSGGGGSEVQLVESGGGLVQPGGSLRLSCAASGFTFNSYAMNWVRQAPGKGLEWVARIRSK YNNYATYYADSVKGRFTISRDDSKNTAYLQMNSLKTEDTAVYYCVRHGNFGNSYVSWWAYWG QGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVF GGGTKLTVL |
| 219 | EGF-4 | DLL3-14 xF12Q | bispecific molecule | QVQLVQSGAEVKKPGASVKVSCKASGYTFTNYYMHWVRQAPGLGLEWMGIINPSDGSTSYAQ KFQGRVTMTRDTSTNTVYMDLSSLRSEDTAVYYCARGGNSAFYSYYDMDVWGQGTTVTVSSG GGSGGGGSGGGGSDVVMTQTPLSLPVTLGQPASISCRSSQSLVYRDGNTYLSWFQQRPGQS PRRLIYKVSNWQSGVPDRFSGGGSGTDFTLKISRVEAEDVGVYYCMQGTHWPPTFGQGTKVE IKSGGGGSEVQLVESGGGLVQPGGSLRLSCAASGFTFNSYAMNWVRQAPGKGLEWVARIRSK YNNYATYYADSVKGRFTISRDDSKNTAYLQMNSLKTEDTAVYYCVRHGNFGNSYVSWWAYWG QGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRVVF GGGTKLTVL |
| 220 | EGF-4 | DLL3-15 xF12Q | bispecific molecule | QVQLVQSGAEVKKPGASVKVSCKASGYTFTGYYIHWVRQAPGQGLEWMGIINPSDGSTSYGQ NFQGRVTMTRDTSTNTVYMELSSLRSEDTAVYYCARGGNSAFYSYYDMDVWGQGTTVTVSSG GGGSGGGGSGGGGSDVVMTQSPLSLPVTLGQPASISCRSSQSLAYRDGNTYLSWFQQRPGQS PRRLIYKVSNWQSGVPDRFSGSGSGTDFTLKISRVEAEDVGVYFCMQGTHWPPTFGQGTKVE IKSGGGGSEVQLVESGGGLVQPGGSLRLSCAASGFTFNSYAMNWVRQAPGKGLEWVARIRSK YNNYATYYADSVKGRFTISRDDSKNTAYLQMNSLKTEDTAVYYCVRHGNFGNSYVSWWAYWG QGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVF GGGTKLTVL |
| 221 | N-term. | DLL3-1 xI2C - HALB variant 1 | bispecific molecule - HALB variant 1 | QVQLVESGGGVVQSGRSLRLSCAASGFTFSDYGIHWVRQAPGKGLEWVAVISYHGSNKYYAR SVKGRFTVSRDNSKNTLYLQMNSLRAEDTAVYYCAREIPFGMDVWGQGTTVTVSSGGGGSGG GGSGGGGSDIVMTQTPLSLPVTPGEPASISCRSSQSLLHSDGYNYLDWYLQKPGQSPQLLIY LGSNRASGVPDRFSGSGSGTDFTLTISRVEAEDVGVYYCMQALQTPLTFGGGTKVDIKSGGG GSEVQLVESGGGLVQPGGSLKLSCAASGFTFNKYAMNWVRQAPGKGLEWVARIRSKYNNYAT YYADSVKDRFTISRDDSKNTAYLQMNNLKTEDTAVYYCVRHGNFGNSYISWAYWGQGTLVT VSSGGGGSGGGGSGGGGSQTVVTQEPSLTVSPGGTVTLTCGSSTGAVTSGNYPNWVQQKPGQ APRGLIGGTKFLAPGTPARFSGSLLGGKAALTLSGVQPEDEAEYYCVLWYSNRWVFGGGTKL TVLPGGGGSDAHKSEVAHRFKDLGEENFKALVLIAFAQYLQQCPFEDHVKLVNEVTEFAKTC VADESAENCDKSLHTLFGDKLCTVATLRETYGEMADCCAKQEPERNECFLQHKDDNPNLPRL VRPEVDVMCTAFHDNEETFLKKYLYEIARRHPYFYAPELLFFAKRYKAAFTECCQAADKAAC LLPKLDELRDEGKASSAKQRLKCASLQKFGERAFKAWAVARLSQRFPKAEFAEVSKLVTDLT KVHTECCHGDLLECADDRADLAKYICENQDSISSKLKECCEKPLLEKSHCIAEVENDEMPAD LPSLAADFVESKDVCKNYAEAKDVFLGMFLYEYARRHPDYSVVLLLRLAKTYETTLEKCCAA ADPHECYAKVFDEFKPLVEEPQNLIKQNCELFEQLGEYKFQNALLVRYTKKVPQVSTPTLVE VSRNLGKVGSKCCKHPEAKRMPCAEDYLSVVLNQLCVLHEKTPVSDRVTKCCTESLVNRRPC FSALEVDETYVPKEFNAGTFTFHADICTLSEKERQIKKQTALVELVKHKPKATKEQLKAAMD DFAAFVEKCCKADDKETCFAEEGKKLVAASQAALGLHHHHHH |
| 222 | N-term. | DLL3-2 xI2C - | bispecific molecule - | QVQLVQSGAEVKKPGASVKVSCKASGYTFTGYYMHWVRQAPGQGLEWMGWINPNSGDTNYAQ KFQGRVTMTRDTSISTAYMELSRLTSDDTAVYYCARDANIAALDAFEIWGQGTMVTVSSGGG |

TABLE 18-continued

| SEQ ID NO | DLL3-epitope | Designation | Format / Source | Amino acid sequence |
|---|---|---|---|---|
| | | HALB variant 1 | HALB variant 1 | GSGGGGSGGGGSDIQMTQSPSSLSASVGDRVTITCRASQSISSYLNWYQQKPGKAPKLLIYA ASSLQSGVPSRFSGSGSGTDFTLTISSLQPEDFATYYCQQSYSTPLTFGGGTKVEIKSGGGG SEVQLVESGGGLVQPGGSLKLSCAASGFTFNKYAMNWVRQAPGKGLEWVARIRSKYNNYATY YADSVKDRFTISRDDSKNTAYLQMNNLKTEDTAVYYCVRHGNFGNSYISYWAYWGQGTLVTV SSGGGGSGGGGSGGGGSQTVVTQEPSLTVSPGGTVTLTCGSSTGAVTSGNYPNWVQQKPGQA PRGLIGGTKFLAPGTPARFSGSLLGGKAALTLSGVQPEDEAEYYCVLWYSNRWVFGGGTKLT VLPGGGGSDAHKSEVAHRFKDLGEENFKALVLIAFAQYLQQCPFEDHVKLVNEVTEFAKTCV ADESAENCDKSLHTLFGDKLCTVATLRETYGEMADCCAKQEPERNECFLQHKDDNPNLPRLV RPEVDVMCTAFHDNEETFLKKYLYEIARRHPYFYAPELLFFAKRYKAAFTECCQAADKAACL LPKLDELRDEGKASSAKQRLKCASLQKFGERAFKAWAVARLSQRFPKAEFAEVSKLVTDLTK VHTECCHGDLLECADDRADLAKYICENQDSISSKLKECCEKPLLEKSHCIAEVENDEMPADL PSLAADFVESKDVCKNYAEAKDVFLGMFLYEYARRHPDYSVVLLLRLAKTYETTLEKCCAAA DPHECYAKVFDEFKPLVEEPQNLIKQNCELFEQLGEYKFQNALLVRYTKKVPQVSTPTLVEV SRNLGKVGSKCCKHPEAKRMPCAEDYLSVVLNQLCVLHEKTPVSDRVTKCCTESLVNRRPCF SALEVDETYVPKEFNAGTFTFHADICTLSEKERQIKKQTALVELVKHKPKATKEQLKAAMDD FAAFVEKCCKADDKETCFAEEGKKLVAASQAALGLHHHHHH |
| 223 | EGF-1 | DLL3-3 xI2C - HALB | bispecific molecule - HALB | QVQLVESGGGVVQPGRSLRLSCAASGFTFSSYGMHWVRQAPGKGLEWVAVISYHGRDTYYAR SVKGRFTISRDNSKNTLYLHMNSLRAEDTAVYYCARDGATVTSYYYSGMDVWGQGTTVTVSS GGGGSGGGGSGGGGSDIQMTQSPSSLSASVGDRVTITCRASQGISNYLAWFQQKPGKAPKSL IYLASSLQSGVPSKFSGSGSGTDFTLTISSLQPEDFATYYCQQYNFYPFTFGPGTKVDIKSG GGGSEVQLVESGGGLVQPGGSLKLSCAASGFTFNKYAMNWVRQAPGKGLEWVARIRSKYNNY ATYYADSVKDRFTISRDDSKNTAYLQMNNLKTEDTAVYYCVRHGNFGNSYISYWAYWGQGTL VTVSSGGGGSGGGGSGGGGSQTVVTQEPSLTVSPGGTVTLTCGSSTGAVTSGNYPNWVQQKP GQAPRGLIGGTKFLAPGTPARFSGSLLGGKAALTLSGVQPEDEAEYYCVLWYSNRWVFGGGT KLTVLPGGGGSDAHKSEVAHRFKDLGEENFKALVLIAFAQYLQQCPFEDHVKLVNEVTEFAK TCVADESAENCDKSLHTLFGDKLCTVATLRETYGEMADCCAKQEPERNEQFLQHKDDNPNLP RLVRPEVDVMCTAFHDNEETFLKKYLYEIARRHPYFYAPELLFFAKRYKAAFTECCQAADKA ACLLPKLDELRDEGKASSAKQRLKCASLQKFGERAFKAWAVARLSQRFPKAEFAEVSKLVTD LTKVHTECCHGDLLECADDRADLAKYICENQDSISSKLKECCEKPLLEKSHCIAEVENDEMP ADLPSLAADFVESKDVCKNYAEAKDVFLGMFLYEYARRHPDYSVVLLLRLAKTYETTLEKCC AAADPHECYAKVFDEFKPLVEEPQNLIKQNCELFEQLGEYKFQNALLVRYTKKVPQVSTPTL VEVSRNLGKVGSKCCKHPEAKRMPCAEDYLSVVLNQLCVLHEKTPVSDRVTKCCTESLVNRR PCFSALEVDETYVPKEFNAETFTFHADICTLSEKERQIKKQTALVELVKHKPKATKEQLKAV MDDFAAFVEKCCKADDKETCFAEEGKKLVAASQAALGLHHHHHH |
| 224 | EGF-3 | DLL3-4 xI2C - HALB | bispecific molecule - HALB | QVQLQESGPGLVKPSETLSLTCTVSGGSISSYYWSWIRQPPGKGLEWIGYVYYSGTTNYNPS LKSRVTISVDTSKNQFSLKLSSVTAADTAVYYCASIAVTGFYFDYWGQGTLVTVSSGGGGGS GGGGSGGGGSEIVLTQSPGTLSLSPGERVTLSCRASQVRNNNYLAWYQQRPGQAPRLLIYGAS SRATGIPDRFSGSGSGTDFTLTISRLEPEDFAVYYCQQYDRSPLTFGGGTKLEIKSGGGGSE VQLVESGGGLVQPGGSLKLSCAASGFTFNKYAMNWVRQAPGKGLEWVARIRSKYNNYATYYA DSVKDRFTISRDDSKNTAYLQMNNLKTEDTAVYYCVRHGNFGNSYISYWAYWGQGTLVTVSS GGGGSGGGGSGGGGSQTVVTQEPSLTVSPGGTVTLTCGSSTGAVTSGNYPNWVQQKPGQAPR GLIGGTKFLAPGTPARFSGSLLGGKAALTLSGVQPEDEAEYYCVLWYSNRWVFGGGTKLTVL PGGGGSDAHKSEVAHRFKDLGEENFKALVLIAFAQYLQQCPFEDHVKLVNEVTEFAKTCVAD ESAENCDKSLHTLFGDKLCTVATLRETYGEMADCCAKQEPERNECFLQHKDDNPNLPRLVRP EVDVMCTAFHDNEETFLKKYLYEIARRHPYFYAPELLFFAKRYKAAFTECCQAADKAACLLP KLDELRDEGKASSAKQRLKCASLQKFGERAFKAWAVARLSQRFPKAEFAEVSKLVTDLTKVH TECCHGDLLECADDRADLAKYICENQDSISSKLKECCEKPLLEKSHCIAEVENDEMPADLPS LAADFVESKDVCKNYAEAKDVFLGMFLYEYARRHPDYSVVLLLRLAKTYETTLEKCCAAADP HECYAKVFDEFKPLVEEPQNLIKQNCELFEQLGEYKFQNALLVRYTKKVPQVSTPTLVEVSR NLGKVGSKCCKHPEAKRMPCAEDYLSVVLNQLCVLHEKTPVSDRVTKCCTESLVNRRPCFSA LEVDETYVPKEFNAETFTFHADICTLSEKERQIKKQTALVELVKHKPKATKEQLKAVMDDFA AFVEKCCKADDKETCFAEEGKKLVAASQAALGLHHHHHH |
| 225 | EGF-3 | DLL3-5 xI2C - HALB | bispecific molecule - HALB | QVQLQESGPGLVKPSETLSLTCTVSGGSISSYYWSWIRQPPGKGLEWIGYIYYSGRTNYYPS LKSRVTISIDTSKNQFSLKLSSVTAADTAVYYCARIAVAGFFFDYWGQGTLVTVSSGGGGSG GGGSGGGGSEIVLTQSPGTLSLSPGERATLSCRASQSVNKNYLAWYQQKPGQAPRLLIYGAS SRATGIPDRFSGSGSGTDFTLTISRLEPEDFAVYYCQQYDRSPLTFGGGTKLEIKSGGGGSE VQLVESGGGLVQPGGSLKLSCAASGFTFNKYAMNWVRQAPGKGLEWVARIRSKYNNYATYYA DSVKDRFTISRDDSKNTAYLQMNNLKTEDTAVYYCVRHGNFGNSYISYWAYWGQGTLVTVSS GGGGSGGGGSGGGGSQTVVTQEPSLTVSPGGTVTLTCGSSTGAVTSGNYPNWVQQKPGQAPR GLIGGTKFLAPGTPARFSGSLLGGKAALTLSGVQPEDEAEYYCVLWYSNRWVFGGGTKLTVL PGGGGSDAHKSEVAHRFKDLGEENFKALVLIAFAQYLQQCPFEDHVKLVNEVTEFAKTCVAD ESAENCDKSLHTLFGDKLCTVATLRETYGEMADCCAKQEPERNECFLQHKDDNPNLPRLVRP EVDVMCTAFHDNEETFLKKYLYEIARRHPYFYAPELLFFAKRYKAAFTECCQAADKAACLLP KLDELRDEGKASSAKQRLKCASLQKFGERAFKAWAVARLSQRFPKAEFAEVSKLVTDLTKVH TECCHGDLLECADDRADLAKYICENQDSISSKLKECCEKPLLEKSHCIAEVENDEMPADLPS LAADFVESKDVCKNYAEAKDVFLGMFLYEYARRHPDYSVVLLLRLAKTYETTLEKCCAAADP HECYAKVFDEFKPLVEEPQNLIKQNCELFEQLGEYKFQNALLVRYTKKVPQVSTPTLVEVSR NLGKVGSKCCKHPEAKRMPCAEDYLSVVLNQLCVLHEKTPVSDRVTKCCTESLVNRRPCFSA LEVDETYVPKEFNAETFTFHADICTLSEKERQIKKQTALVELVKHKPKATKEQLKAVMDDFA AFVEKCCKADDKETCFAEEGKKLVAASQAALGLHHHHHH |
| 226 | EGF-3 | DLL3-6 xI2C - | bispecific molecule - | QVQLQESGPGLVKPSETLSLTCTVSGASISSFYWSWIRQPPGKGLEWIGYIYYSGTTNYNPS LKSRVTISVDTSKNQFSLKLSSVTAADTAVYYCARIAVAGFFFDYWGQGTLVTVSSGGGGSG |

TABLE 18-continued

| SEQ ID NO | DLL3-epitope | Designation | Format / Source | Amino acid sequence |
|---|---|---|---|---|
| | | HALB | HALB | GGGSGGGGSEIVLTQSPGTLSLSPGERATLSCRASQSVNKNYLAWYQQKPGQAPRLLIYGAS<br>SRATGIPDRFSGSGSGTDFTLTISRLEPEDFAVYYCQQYDRSPLTFGGGTKVEIKSGGGGSE<br>VQLVESGGGLVQPGGSLKLSCAASGFTFNKYAMNWVRQAPGKGLEWVARIRSKYNNYATYYA<br>DSVKDRFTISRDDSKNTAYLQMNNLKTEDTAVYYCVRHGNFGNSYISYWAYWGQGTLVTVSS<br>GGGGSGGGGSGGGGSQTVVTQEPSLTVSPGGTVTLTCGSSTGAVTSGNYPNWVQQKPGQAPR<br>GLIGGTKFLAPGTPARFSGSLLGGKAALTLSGVQPEDEAEYYCVLWYSNRWVFGGGTKLTVL<br>PGGGGSDAHKSEVAHRFKDLGEENFKALVLIAFAQYLQQCPFEDHVKLVNEVTEFAKTCVAD<br>ESAENCDKSLHTLFGDKLCTVATLRETYGEMADCCAKQEPERNECFLQHKDDNPNLPRLVRP<br>EVDVMCTAFHDNEETFLKKYLYEIARRHPYFYAPELLFFAKRYKAAFTECCQAADKAACLLP<br>KLDELRDEGKASSAKQRLKCASLQKFGERAFKAWAVARLSQRFPKAEFAEVSKLVTDLTKVH<br>TECCHGDLLECADDRADLAKYICENQDSISSKLKECCEKPLLEKSHCIAEVENDEMPADLPS<br>LAADFVESKDVCKNYAEAKDVFLGMFLYEYARRHPDYSVVLLLRLAKTYETTLEKCCAAADP<br>HECYAKVFDEFKPLVEEPQNLIKQNCELFEQLGEYKFQNALLVRYTKKVPQVSTPTLVEVSR<br>NLGKVGSKCCKHPEAKRMPCAEDYLSVVLNQLCVLHEKTPVSDRVTKCCTESLVNRRPCFSA<br>LEVDETYVPKEFNAETFTFHADICTLSEKERQIKKQTALVELVKHKPKATKEQLKAVMDDFA<br>AFVEKCCKADDKETCFAEEGKKLVAASQAALGLHHHHHH |
| 227 | EGF-3 | DLL3-7 xI2C - HALB | bispecific molecule - HALB | QVQLQESGPGLVKPSQTLSLTCTVSGASISSFYWSWIRQPPGKGLEWIGYIYYSGTTNYNPS<br>LKSRVTISVDTSKNQFSLKLSSVTAADTAVYYCARIAVAGFFFDYWGQGTLVTVSSGGGGGS<br>GGGSGGGGSEIVLTQSPGTLSLSPGERATLSCRASQSVNKNYLAWYQQKPGQAPRLLIYGAS<br>SRATGIPDRFSGSGSGTDFTLTISRLEPEDFAVYYCQQYDRSPLTFGGGTKVEIKSGGGGSE<br>VQLVESGGGLVQPGGSLKLSCAASGFTFNKYAMNWVRQAPGKGLEWVARIRSKYNNYATYYA<br>DSVKDRFTISRDDSKNTAYLQMNNLKTEDTAVYYCVRHGNFGNSYISYWAYWGQGTLVTVSS<br>GGGGSGGGGSGGGGSQTVVTQEPSLTVSPGGTVTLTCGSSTGAVTSGNYPNWVQQKPGQAPR<br>GLIGGTKFLAPGTPARFSGSLLGGKAALTLSGVQPEDEAEYYCVLWYSNRWVFGGGTKLTVL<br>PGGGGSDAHKSEVAHRFKDLGEENFKALVLIAFAQYLQQCPFEDHVKLVNEVTEFAKTCVAD<br>ESAENCDKSLHTLFGDKLCTVATLRETYGEMADCCAKQEPERNECFLQHKDDNPNLPRLVRP<br>EVDVMCTAFHDNEETFLKKYLYEIARRHPYFYAPELLFFAKRYKAAFTECCQAADKAACLLP<br>KLDELRDEGKASSAKQRLKCASLQKFGERAFKAWAVARLSQRFPKAEFAEVSKLVTDLTKVH<br>TECCHGDLLECADDRADLAKYICENQDSISSKLKECCEKPLLEKSHCIAEVENDEMPADLPS<br>LAADFVESKDVCKNYAEAKDVFLGMFLYEYARRHPDYSVVLLLRLAKTYETTLEKCCAAADP<br>HECYAKVFDEFKPLVEEPQNLIKQNCELFEQLGEYKFQNALLVRYTKKVPQVSTPTLVEVSR<br>NLGKVGSKCCKHPEAKRMPCAEDYLSVVLNQLCVLHEKTPVSDRVTKCCTESLVNRRPCFSA<br>LEVDETYVPKEFNAETFTFHADICTLSEKERQIKKQTALVELVKHKPKATKEQLKAVMDDFA<br>AFVEKCCKADDKETCFAEEGKKLVAASQAALGLHHHHHH |
| 228 | EGF-3 | DLL3-8 xI2C - HALB | bispecific molecule - HALB | QVQLQEWGPGLVKPSETLSLTCTVSGASISSFYWSWIRQPPGKGLEWIGYIYYSGTTNYNPS<br>LKSRVTISVDTSKNQLSLKLSSVTAADTAVYYCARIAVAGFFFDYWGQGTLVTVSSGGGGS<br>GGGSGGGGSEIVLTQSPGTLSLSPGERATLSCRASQSVNKNYLAWYQQKPGQAPRLLIYGAS<br>SRATGIPDRFSGSGSGTDFTLTISRLEPEDFAVYYCQQYDRSPLTFGGGTKVDIKSGGGGSE<br>VQLVESGGGLVQPGGSLKLSCAASGFTFNKYAMNWVRQAPGKGLEWVARIRSKYNNYATYYA<br>DSVKDRFTISRDDSKNTAYLQMNNLKTEDTAVYYCVRHGNFGNSYISYWAYWGQGTLVTVSS<br>GGGGSGGGGSGGGGSQTVVTQEPSLTVSPGGTVTLTCGSSTGAVTSGNYPNWVQQKPGQAPR<br>GLIGGTKFLAPGTPARFSGSLLGGKAALTLSGVQPEDEAEYYCVLWYSNRWVFGGGTKLTVL<br>PGGGGSDAHKSEVAHRFKDLGEENFKALVLIAFAQYLQQCPFEDHVKLVNEVTEFAKTCVAD<br>ESAENCDKSLHTLFGDKLCTVATLRETYGEMADCCAKQEPERNECFLQHKDDNPNLPRLVRP<br>EVDVMCTAFHDNEETFLKKYLYEIARRHPYFYAPELLFFAKRYKAAFTECCQAADKAACLLP<br>KLDELRDEGKASSAKQRLKCASLQKFGERAFKAWAVARLSQRFPKAEFAEVSKLVTDLTKVH<br>TECCHGDLLECADDRADLAKYICENQDSISSKLKECCEKPLLEKSHCIAEVENDEMPADLPS<br>LAADFVESKDVCKNYAEAKDVFLGMFLYEYARRHPDYSVVLLLRLAKTYETTLEKCCAAADP<br>HECYAKVFDEFKPLVEEPQNLIKQNCELFEQLGEYKFQNALLVRYTKKVPQVSTPTLVEVSR<br>NLGKVGSKCCKHPEAKRMPCAEDYLSVVLNQLCVLHEKTPVSDRVTKCCTESLVNRRPCFSA<br>LEVDETYVPKEFNAETFTFHADICTLSEKERQIKKQTALVELVKHKPKATKEQLKAVMDDFA<br>AFVEKCCKADDKETCFAEEGKKLVAASQAALGLHHHHHH |
| 229 | EGF-3 | DLL3-9 xI2C - HALB | bispecific molecule - HALB | QVQLQESGPGLVKPSETLSLTCTVSGASISSFYWSWIRQPPGKGLEWIGYIYYSGTTNYNPS<br>LKSRVTISVDTSKNQFSLKLSSVTAADTAVYYCARIAVAGFFFDYWGQGTLVTVSSGGGGSG<br>GGGSGGGGSEIVLTQSPGTLSLSPGESATLSCRASQSVNKNYLAWYQQKPGQAPRLLIYGAS<br>SRATGIPDRFSGSGSGTDFTLTISRLEPEDFAVYYCQQYDRSPLTFGGGTRLEIKSGGGGSE<br>VQLVESGGGLVQPGGSLKLSCAASGFTFNKYAMNWVRQAPGKGLEWVARIRSKYNNYATYYA<br>DSVKDRFTISRDDSKNTAYLQMNNLKTEDTAVYYCVRHGNFGNSYISYWAYWGQGTLVTVSS<br>GGGGSGGGGSGGGGSQTVVTQEPSLTVSPGGTVTLTCGSSTGAVTSGNYPNWVQQKPGQAPR<br>GLIGGTKFLAPGTPARFSGSLLGGKAALTLSGVQPEDEAEYYCVLWYSNRWVFGGGTKLTVL<br>PGGGGSDAHKSEVAHRFKDLGEENFKALVLIAFAQYLQQCPFEDHVKLVNEVTEFAKTCVAD<br>ESAENCDKSLHTLFGDKLCTVATLRETYGEMADCCAKQEPERNECFLQHKDDNPNLPRLVRP<br>EVDVMCTAFHDNEETFLKKYLYEIARRHPYFYAPELLFFAKRYKAAFTECCQAADKAACLLP<br>KLDELRDEGKASSAKQRLKCASLQKFGERAFKAWAVARLSQRFPKAEFAEVSKLVTDLTKVH<br>TECCHGDLLECADDRADLAKYICENQDSISSKLKECCEKPLLEKSHCIAEVENDEMPADLPS<br>LAADFVESKDVCKNYAEAKDVFLGMFLYEYARRHPDYSVVLLLRLAKTYETTLEKCCAAADP<br>HECYAKVFDEFKPLVEEPQNLIKQNCELFEQLGEYKFQNALLVRYTKKVPQVSTPTLVEVSR<br>NLGKVGSKCCKHPEAKRMPCAEDYLSVVLNQLCVLHEKTPVSDRVTKCCTESLVNRRPCFSA<br>LEVDETYVPKEFNAETFTFHADICTLSEKERQIKKQTALVELVKHKPKATKEQLKAVMDDFA<br>AFVEKCCKADDKETCFAEEGKKLVAASQAALGLHHHHHH |
| 230 | EGF-3 | DLL3-10 xI2C - | bispecific molecule - | QVQLQESGPGLVKPSQTLSLTCTVSGGSISSYYWSWIRQPPGKGLEWIGYIFYNGITNYNPS<br>LKSRVTISLDTSKNQFSLKLSSVTAADTAKYYCARIHSGSFSFDYWDQGTLVTVSSGGGGSG |

TABLE 18-continued

| SEQ ID NO | DLL3-epitope | Designation | Format / Source | Amino acid sequence |
|---|---|---|---|---|
| | | HALB | HALB | GGGSGGGGSEIVMTQSPGTLSLSPGERATLSCRASQSVSRGYLAWYQQKPGQAPRLLIYGAS SRATDIPDRFSGSGSGTDFTLTISRLEPEDFAVYYCQYDTSPITFGQGTKVEIKSGGGGSE VQLVESGGGLVQPGGSLKLSCAASGFTFNKYAMNWVRQAPGKGLEWVARIRSKYNNYATYYA DSVKDRFTISRDDSKNTAYLQMNNLKTEDTAVYYCVRHGNFGNSYISYWAYWGQGTLVTVSS GGGGSGGGGSGGGGSQTVVTQEPSLTVSPGGTVTLTCGSSTGAVTSGNYPNWVQQKPGQAPR GLIGGTKFLAPGTPARFSGSLLGGKAALTLSGVQPEDEAEYYCVLWYSNRWVFGGGTKLTVL PGGGGSDAHKSEVAHRFKDLGEENFKALVLIAFAQYLQQCPFEDHVKLVNEVTEFAKTCVAD ESAENCDKSLHTLFGDKLCTVATLRETYGEMADCCAKQEPERNECFLQHKDDNPNLPRLVRP EVDVMCTAFHDNEETFLKKYLYEIARRHPYFYAPELLFFAKRYKAAFTECCQAADKAACLLP KLDELRDEGKASSAKQRLKCASLQKFGERAFKAWAVARLSQRFPKAEFAEVSKLVTDLTKVH TECCHGDLLECADDRADLAKYICENQDSISSKLKECCEKPLLEKSHCIAEVENDEMPADLPS LAADFVESKDVCKNYAEAKDVFLGMFLYEYARRHPDYSVVLLLRLAKTYETTLEKCCAAADP HECYAKVFDEFKPLVEEPQNLIKQNCELFEQLGEYKFQNALLVRYTKKVPQVSTPTLVEVSR NLGKVGSKCCKHPEAKRMPCAEDYLSVVLNQLCVLHEKTPVSDRVTKCCTESLVNRRPCFSA LEVDETYVPKEFNAETFTFHADICTLSEKERQIKKQTALVELVKHKPKATKEQLKAVMDDFA AFVEKCCKADDKETCFAEEGKKLVAASQAALGLHHHHHH |
| 231 | EGF-3 | DLL3-11 xI2C - HALB | bispecific molecule - HALB | EVQLVESGGGLVKPGGSLRLSCAASGFIFNNAGMSWVRQAPGKGLEWVGRIKNKIDGGTTDF AAPVKGRFTISRDDSKNTLYLQMNSLKAEDTAVYYCTARGWYGDYFDYWGQGTLVTVSSGGG GSGGGGSGGGGSDIVMTQTPLSLPVTPGEPASISCRSSQSLLHSNGYNYLDWYLQKPGQSPQ LLIYLGSNRASGVPDRFSGSGSGTDFTLKISRVEAEDVGIYYCMQALQTPFTFGPGTKVEIK SGGGGSEVQLVESGGGLVQPGGSLKLSCAASGFTFNKYAMNWVRQAPGKGLEWVARIRSKYN NYATYYADSVKDRFTISRDDSKNTAYLQMNNLKTEDTAVYYCVRHGNFGNSYISYWAYWGQG TLVTVSSGGGGSGGGGSGGGGSQTVVTQEPSLTVSPGGTVTLTCGSSTGAVTSGNYPNWVQQ KPGQAPRGLIGGTKFLAPGTPARFSGSLLGGKAALTLSGVQPEDEAEYYCVLWYSNRWVFGG GTKLTVLPGGGGSDAHKSEVAHRFKDLGEENFKALVLIAFAQYLQQCPFEDHVKLVNEVTEF AKTCVADESAENCDKSLHTLFGDKLCTVATLRETYGEMADCCAKQEPERNECFLQHKDDNPN LPRLVRPEVDVMCTAFHDNEETFLKKYLYEIARRHPYFYAPELLFFAKRYKAAFTECCQAAD KAACLLPKLDELRDEGKASSAKQRLKCASLQKFGERAFKAWAVARLSQRFPKAEFAEVSKLV TDLTKVHTECCHGDLLECADDRADLAKYICENQDSISSKLKECCEKPLLEKSHCIAEVENDE MPADLPSLAADFVESKDVCKNYAEAKDVFLGMFLYEYARRHPDYSVVLLLRLAKTYETTLEK CCAAADPHECYAKVFDEFKPLVEEPQNLIKQNCELFEQLGEYKFQNALLVRYTKKVPQVSTP TLVEVSRNLGKVGSKCCKHPEAKRMPCAEDYLSVVLNQLCVLHEKTPVSDRVTKCCTESLVN RRPCFSALEVDETYVPKEFNAETFTFHADICTLSEKERQIKKQTALVELVKHKPKATKEQLK AVMDDFAAFVEKCCKADDKETCFAEEGKKLVAASQAALGLHHHHHH |
| 232 | EGF-3/[4] | DLL3-12 xI2C - HALB | bispecific molecule - HALB | QVQLVESGGGVVQPGRSLRLSCAASGFSFSSYDIHWVRQAPGKGLEWVAVISSHGSNKNYAR SVKGRFTISRDNSKNTLYLQMNSLKAEDTAVYYCARDGYSGNDPFYYYHGMDVWGQGTTVT VSSGGGGSGGGGSGGGGSDIQMTQSPSSLSASVGDRVTITCRASQSISSYLNWYQQKPGKAP KLLIYAASSLQSGVPSRFSGSGSGTDFSLTISSLQPEDFATYYCQQSFTTPLTFGGGTKVEI KSGGGGSEVQLVESGGGLVQPGGSLKLSCAASGFTFNKYAMNWVRQAPGKGLEWVARIRSKY NNYATYYADSVKDRFTISRDDSKNTAYLQMNNLKTEDTAVYYCVRHGNFGNSYISYWAYWGQ GTLVTVSSGGGGSGGGGSGGGGSQTVVTQEPSLTVSPGGTVTLTCGSSTGAVTSGNYPNWVQ QKPGQAPRGLIGGTKFLAPGTPARFSGSLLGGKAALTLSGVQPEDEAEYYCVLWYSNRWVFG GGTKLTVLPGGGGSDAHKSEVAHRFKDLGEENFKALVLIAFAQYLQQCPFEDHVKLVNEVTE FAKTCVADESAENCDKSLHTLFGDKLCTVATLRETYGEMADCCAKQEPERNECFLQHKDDNP NLPRLVRPEVDVMCTAFHDNEETFLKKYLYEIARRHPYFYAPELLFFAKRYKAAFTECCQAA DKAACLLPKLDELRDEGKASSAKQRLKCASLQKFGERAFKAWAVARLSQRFPKAEFAEVSKL VTDLTKVHTECCHGDLLECADDRADLAKYICENQDSISSKLKECCEKPLLEKSHCIAEVEND EMPADLPSLAADFVESKDVCKNYAEAKDVFLGMFLYEYARRHPDYSVVLLLRLAKTYETTLE KCCAAADPHECYAKVFDEFKPLVEEPQNLIKQNCELFEQLGEYKFQNALLVRYTKKVPQVST PTLVEVSRNLGKVGSKCCKHPEAKRMPCAEDYLSVVLNQLCVLHEKTPVSDRVTKCCTESLV NRRPCFSALEVDETYVPKEFNAETFTFHADICTLSEKERQIKKQTALVELVKHKPKATKEQL KAVMDDFAAFVEKCCKADDKETCFAEEGKKLVAASQAALGLHHHHHH |
| 233 | EGF-4 | DLL3-13 xI2C - HALB | bispecific molecule - HALB | QVQLVQSGAEVKKPGASVKVSCKASGYTFTSYYMHWVRQAPGQGLEWMGIINPSDGSTNYAQ NFQGRVTMTRDTSTNTVYMELSSLRSEDTAVYYCARGGNSAFYSYYDMDVWGQGTTVTVSSG GGGSGGGGSGGGGSDVVMTQSPLSLPVTLGQPASISCRSSQSLVYRDGNTYLSWFQQRPGQS PRRLIYKVSNWQSGVPDRFSGSGSGTDFTLKISRVEAEDVGVYFCMQGTHWPPTFGQGTKVE IKSGGGGSEVQLVESGGGLVQPGGSLKLSCAASGFTFNKYAMNWVRQAPGKGLEWVARIRSK YNNYATYYADSVKDRFTISRDDSKNTAYLQMNNLKTEDTAVYYCVRHGNFGNSYISYWAYWG QGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVF GGGTKLTVLPGGGGSDAHKSEVAHRFKDLGEENFKALVLIAFAQYLQQCPFEDHVKLVNEVT EFAKTCVADESAENCDKSLHTLFGDKLCTVATLRETYGEMADCCAKQEPERNECFLQHKDDN PNLPRLVRPEVDVMCTAFHDNEETFLKKYLYEIARRHPYFYAPELLFFAKRYKAAFTECCQA ADKAACLLPKLDELRDEGKASSAKQRLKCASLQKFGERAFKAWAVARLSQRFPKAEFAEVSK LVTDLTKVHTECCHGDLLECADDRADLAKYICENQDSISSKLKECCEKPLLEKSHCIAEVEN DEMPADLPSLAADFVESKDVCKNYAEAKDVFLGMFLYEYARRHPDYSVVLLLRLAKTYETTL EKCCAAADPHECYAKVFDEFKPLVEEPQNLIKQNCELFEQLGEYKFQNALLVRYTKKVPQVS TPTLVEVSRNLGKVGSKCCKHPEAKRMPCAEDYLSVVLNQLCVLHEKTPVSDRVTKCCTESL VNRRPCFSALEVDETYVPKEFNAETFTFHADICTLSEKERQIKKQTALVELVKHKPKATKEQ LKAVMDDFAAFVEKCCKADDKETCFAEEGKKLVAASQAALGLHHHHHH |
| 234 | EGF-4 | DLL3-14 xI2C - | bispecific molecule - | QVQLVQSGAEVKKPGASVKVSCKASGYTFTNYYMHWVRQAPGLGLEWMGIINPSDGSTSYAQ KFQGRVTMTRDTSTNTVYMDLSSLRSEDTAVYYCARGGNSAFYSYYDMDVWGQGTTVTVSSG |

TABLE 18-continued

| SEQ ID NO | DLL3-epitope | Designation | Format / Source | Amino acid sequence |
|---|---|---|---|---|
| | | HALB | HALB | GGGSGGGGSGGGGSDVVMTQTPLSLPVTLGQPASISCRSSQSLVYRDGNTYLSWFQQRPGQS PRRLIYKVSNWQSGVPDRFSGGGSGTDFTLKISRVEAEDVGVYYCMQGTHWPPTFGQGTKVE IKSGGGGSEVQLVESGGGLVQPGGSLKLSCAASGFTFNKYAMNWVRQAPGKGLEWVARIRSK YNNYATYYADSVKDRFTISRDDSKNTAYLQMNNLKTEDTAVYYCVRHGNFGNSYISYWAYWG QGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVF GGGTKLTVLPGGGSDAHKSEVAHRFKDLGEENFKALVLIAFAQYLQQCPFEDHVKLVNEVT EFAKTCVADESAENCDKSLHTLFGDKLCTVATLRETYGEMADCCAKQEPERNECFLQHKDDN PNLPRLVRPEVDVMCTAFHDNEETFLKKYLYEIARRHPYFYAPELLFFAKRYKAAFTECCQA ADKAACLLPKLDELRDEGKASSAKQRLKCASLQKFGERAFKAWAVARLSQRFPKAEFAEVSK LVTDLTKVHTECCHGDLLECADDRADLAKYICENQDSISSKLKECCEKPLLEKSHCIAEVEN DEMPADLPSLAADFVESKDVCKNYAEAKDVFLGMFLYEYARRHPDYSVVLLLRLAKTYETTL EKCCAAADPHECYAKVFDEFKPLVEEPQNLIKQNCELFEQLGEYKFQNALLVRYTKKVPQVS TPTLVEVSRNLGKVGSKCCKHPEAKRMPCAEDYLSVVLNQLCVLHEKTPVSDRVTKCCTESL VNRRPCFSALEVDETYVPKEFNAETFTFHADICTLSEKERQIKKQTALVELVKHKPKATKEQ LKAVMDDFAAFVEKCCKADDKETCFAEEGKKLVAASQAALGLHHHHHH |
| 235 | EGF-4 | DLL3-15 xI2C - HALB | bispecific molecule - HALB | QVQLVQSGAEVKKPGASVKVSCKASGYTFTGYYIHWVRQAPGQGLEWMGIINPSDGSTSYGQ NFQGRVTMTRDTSTNTVYMELSSLRSEDTAVYYCARGGNSAFYSYYDMDVWGQGTTVTVSSG GGGSGGGGSGGGGSDVVMTQSPLSLPVTLGQPASISCRSSQSLAYRDGNTYLSWFQQRPGQS PRRLIYKVSNWQSGVPDRFSGSGSGTDFTLKISRVEAEDVGVYFCMQGTHWPPTFGQGTKVE IKSGGGGSEVQLVESGGGLVQPGGSLKLSCAASGFTFNKYAMNWVRQAPGKGLEWVARIRSK YNNYATYYADSVKDRFTISRDDSKNTAYLQMNNLKTEDTAVYYCVRHGNFGNSYISYWAYWG QGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVF GGGTKLTVLPGGGSDAHKSEVAHRFKDLGEENFKALVLIAFAQYLQQCPFEDHVKLVNEVT EFAKTCVADESAENCDKSLHTLFGDKLCTVATLRETYGEMADCCAKQEPERNECFLQHKDDN PNLPRLVRPEVDVMCTAFHDNEETFLKKYLYEIARRHPYFYAPELLFFAKRYKAAFTECCQA ADKAACLLPKLDELRDEGKASSAKQRLKCASLQKFGERAFKAWAVARLSQRFPKAEFAEVSK LVTDLTKVHTECCHGDLLECADDRADLAKYICENQDSISSKLKECCEKPLLEKSHCIAEVEN DEMPADLPSLAADFVESKDVCKNYAEAKDVFLGMFLYEYARRHPDYSVVLLLRLAKTYETTL EKCCAAADPHECYAKVFDEFKPLVEEPQNLIKQNCELFEQLGEYKFQNALLVRYTKKVPQVS TPTLVEVSRNLGKVGSKCCKHPEAKRMPCAEDYLSVVLNQLCVLHEKTPVSDRVTKCCTESL VNRRPCFSALEVDETYVPKEFNAETFTFHADICTLSEKERQIKKQTALVELVKHKPKATKEQ LKAVMDDFAAFVEKCCKADDKETCFAEEGKKLVAASQAALGLHHHHHH |
| 236 | EGF-4 | DLL3-16 xI2C - HALB | bispecific molecule - HALB | QVQLVQSGAEVKKPGASVKVSCKASGYTFTGHYMHWVRQAPGQGLEWMGIINPSDGSTNYAQ KFQGRVTMTRDTSTSTVYMELSSLRSEDTAVYYCTRGTTVVHYSYYDMDVWGQGTTVTVSSG GGGSGGGGSGGGGSDVVMTQTPLSLPVTLGQPASISCRSSQSLVYRDGNTYLTWFQQRPGQS PRRLIYKVSNWQSGVPDRFSGSGSGTDFTLKISRVEAEDVGVYYCMQGTHWPPTFGGGTKVE IKSGGGGSEVQLVESGGGLVQPGGSLKLSCAASGFTFNKYAMNWVRQAPGKGLEWVARIRSK YNNYATYYADSVKDRFTISRDDSKNTAYLQMNNLKTEDTAVYYCVRHGNFGNSYISYWAYWG QGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVF GGGTKLTVLPGGGSDAHKSEVAHRFKDLGEENFKALVLIAFAQYLQQCPFEDHVKLVNEVT EFAKTCVADESAENCDKSLHTLFGDKLCTVATLRETYGEMADCCAKQEPERNECFLQHKDDN PNLPRLVRPEVDVMCTAFHDNEETFLKKYLYEIARRHPYFYAPELLFFAKRYKAAFTECCQA ADKAACLLPKLDELRDEGKASSAKQRLKCASLQKFGERAFKAWAVARLSQRFPKAEFAEVSK LVTDLTKVHTECCHGDLLECADDRADLAKYICENQDSISSKLKECCEKPLLEKSHCIAEVEN DEMPADLPSLAADFVESKDVCKNYAEAKDVFLGMFLYEYARRHPDYSVVLLLRLAKTYETTL EKCCAAADPHECYAKVFDEFKPLVEEPQNLIKQNCELFEQLGEYKFQNALLVRYTKKVPQVS TPTLVEVSRNLGKVGSKCCKHPEAKRMPCAEDYLSVVLNQLCVLHEKTPVSDRVTKCCTESL VNRRPCFSALEVDETYVPKEFNAETFTFHADICTLSEKERQIKKQTALVELVKHKPKATKEQ LKAVMDDFAAFVEKCCKADDKETCFAEEGKKLVAASQAALGLHHHHHH |
| 237 | EGF-4 | DLL3-17 xI2C - HALB | bispecific molecule - HALB | QVQLVQSGAEVKKPGASVKVSCKASGYTFTNYFMHWVRQAPGQGLEWMGIINPSDGSTSYAQ NFQGRVTMTRDTSTNTVYMELSSLRSEDTAVYYCARGGNSAFYSYYDMDVWGQGTTVTVSSG GGGSGGGGSGGGGSDVVMTQSPLSLPVTLGQPASISCRSSQSLVYRDGNTYLSWFQQRPGQS PRRLIYRVSNWQSGVPDRFSGSGSGTDFTLKISRVEAEDVGVYYCMQGTYWPPTFGQGTKVD IKSGGGGSEVQLVESGGGLVQPGGSLKLSCAASGFTFNKYAMNWVRQAPGKGLEWVARIRSK YNNYATYYADSVKDRFTISRDDSKNTAYLQMNNLKTEDTAVYYCVRHGNFGNSYISYWAYWG QGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVF GGGTKLTVLPGGGSDAHKSEVAHRFKDLGEENFKALVLIAFAQYLQQCPFEDHVKLVNEVT EFAKTCVADESAENCDKSLHTLFGDKLCTVATLRETYGEMADCCAKQEPERNECFLQHKDDN PNLPRLVRPEVDVMCTAFHDNEETFLKKYLYEIARRHPYFYAPELLFFAKRYKAAFTECCQA ADKAACLLPKLDELRDEGKASSAKQRLKCASLQKFGERAFKAWAVARLSQRFPKAEFAEVSK LVTDLTKVHTECCHGDLLECADDRADLAKYICENQDSISSKLKECCEKPLLEKSHCIAEVEN DEMPADLPSLAADFVESKDVCKNYAEAKDVFLGMFLYEYARRHPDYSVVLLLRLAKTYETTL EKCCAAADPHECYAKVFDEFKPLVEEPQNLIKQNCELFEQLGEYKFQNALLVRYTKKVPQVS TPTLVEVSRNLGKVGSKCCKHPEAKRMPCAEDYLSVVLNQLCVLHEKTPVSDRVTKCCTESL VNRRPCFSALEVDETYVPKEFNAETFTFHADICTLSEKERQIKKQTALVELVKHKPKATKEQ LKAVMDDFAAFVEKCCKADDKETCFAEEGKKLVAASQAALGLHHHHHH |
| 238 | EGF-5/[6] | DLL3-18 xI2C - | bispecific molecule - | QVQLVESGGGAVQPGRSLRLSCAASGFTFSNYGMHWVRQAPGKGLEWVAVISHHGSSKYYAR SVKGRFTISRDNSKNTLYLEMNSLRAEDTAVYYCARDWWELVFDYWGQGTLVTVSSGGGGSG |

TABLE 18-continued

| SEQ ID NO | DLL3-epi-tope | Desig-nation | Format / Source | Amino acid sequence |
|---|---|---|---|---|
| | | HALB | HALB | GGGSGGGGSDIVMTQTPLSLSVTPGQPASISCKSSQSLLHSDGKTFLYWYLQKPGQPPQLLI YEVSNRFSGVPDRFSGSGSGTDFTLKISRVEAEDVGVYYCLQGIHLPFTFGPGTKVEIKSGG GGSEVQLVESGGGLVQPGGSLKLSCAASGFTFNKYAMNWVRQAPGKGLEWVARIRSKYNNYA TYYADSVKDRFTISRDDSKNTAYLQMNNLKTEDTAVYYCVRHGNFGNSYISYWAYWGQGTLV TVSSGGGGSGGGGSGGGGSQTVVTQEPSLTVSPGGTVTLTCGSSTGAVTSGNYPNWVQQKPG QAPRGLIGGTKFLAPGTPARFSGSLLGGKAALTLSGVQPEDEAEYYCVLWYSNRWVFGGGTK LTVLPGGGSDAHKSEVAHRFKDLGEENFKALVLIAFAQYLQQCPFEDHVKLVNEVTEFAKT CVADESAENCDKSLHTLFGDKLCTVATLRETYGEMADCCAKQEPERNECFLQHKDDNPNLPR LVRPEVDVMCTAFHDNEETFLKKYLYEIARRHPYFYAPELLFFAKRYKAAFTECCQAADKAA CLLPKLDELRDEGKASSAKQRLKCASLQKFGERAFKAWAVARLSQRFPKAEFAEVSKLVTDL TKVHTECCHGDLLECADDRADLAKYICENQDSISSKLKECCEKPLLEKSHCIAEVENDEMPA DLPSLAADFVESKDVCKNYAEAKDVFLGMPLYEYARRHPDYSVVLLLRLAKTYETTLEKCCA AADPHECYAKVFDEFKPLVEEPQNLIKQNCELFEQLGEYKFQNALLVRYTKKVPQVSTPTLV EVSRNLGKVGSKCCKHPEAKRMPCAEDYLSVVLNQLCVLHEKTPVSDRVTKCCTESLVNRRP CFSALEVDETYVPKEFNAETFTFHADICTLSEKERQIKKQTALVELVKHKPKATKEQLKAVM DDFAAFVEKCCKADDKETCFAEEGKKLVAASQAALGLHHHHHH |
| 239 | EGF-5/[6] | DLL3-19 xI2C - HALB | bispecific molecule - HALB | QVTLKESGPMLVKPTETLTLTCTVSGFSLSNSRMGVSWIRQPPGRALEWLAHIFSNDGKSYS TSLKSRLTISKDTSKSQVVLTMTNMDPVDTATYYCARYNYDSSGYYYSFFDYWGQGTLVTVS SGGGGSGGGGSGGGGSDIQMTQSPSSLSASVGDRVTITCRASQSISSYLNWYQQKPGKAPKL LIYAASSLQSGVPSRFSGSGSGTDFTLTISSLQPEDFATYYCQQGYSSPFTFGGGTKVEIKS GGGGSEVQLVESGGGLVQPGGSLKLSCAASGFTFNKYAMNWVRQAPGKGLEWVARIRSKYNN YATYYADSVKDRFTISRDDSKNTAYLQMNNLKTEDTAVYYCVRHGNFGNSYISYWAYWGQGT LVTVSSGGGGSGGGGSGGGGSQTVVTQEPSLTVSPGGTVTLTCGSSTGAVTSGNYPNWVQQK PGQAPRGLIGGTKFLAPGTPARFSGSLLGGKAALTLSGVQPEDEAEYYCVLWYSNRWVFGGG TKLTVLPGGGSDAHKSEVAHRFKDLGEENFKALVLIAFAQYLQQCPFEDHVKLVNEVTEFA KTCVADESAENCDKSLHTLFGDKLCTVATLRETYGEMADCCAKQEPERNECFLQHKDDNPNL PRLVRPEVDVMCTAFHDNEETFLKKYLYEIARRHPYFYAPELLFFAKRYKAAFTECCQAADK AACLLPKLDELRDEGKASSAKQRLKCASLQKFGERAFKAWAVARLSQRFPKAEFAEVSKLVT DLTKVHTECCHGDLLECADDRADLAKYICENQDSISSKLKECCEKPLLEKSHCIAEVENDEM PADLPSLAADFVESKDVCKNYAEAKDVFLGMFLYEYARRHPDYSVVLLLRLAKTYETTLEKC CAAADPHECYAKVFDEFKPLVEEPQNLIKQNCELFEQLGEYKFQNALLVRYTKKVPQVSTPT LVEVSRNLGKVGSKCCKHPEAKRMPCAEDYLSVVLNQLCVLHEKTPVSDRVTKCCTESLVNR RPCFSALEVDETYVPKEFNAETFTFHADICTLSEKERQIKKQTALVELVKHKPKATKEQLKA VMDDFAAFVEKCCKADDKETCFAEEGKKLVAASQAALGLHHHHHH |
| 240 | EGF-5/[6] | DLL3-20 xI2C - HALB | bispecific molecule - HALB | QVTLKESGPVLVKPTETLTLTCTVSGFSLSNARMGVSWLRQPPGKALEWLAHIFSTDEKSYS TSLKSRLTISKDTSKSQVVLTMTNMDPVDTATYYCARYNYDSSGYYYSFFDYWGQGTLVTVS SGGGGSGGGGSGGGGSDIQMTQSPSSLSASVGDRVTITCRASQSIRSYLNWYQQKPGKAPKL LIYGASNLQSGVPSRFSGSGSGTDFTLTISSLQPEDFATYYCQQSYSSPFTFGGGTKVEIKS GGGGSEVQLVESGGGLVQPGGSLKLSCAASGFTFNKYAMNWVRQAPGKGLEWVARIRSKYNN YATYYADSVKDRFTISRDDSKNTAYLQMNNLKTEDTAVYYCVRHGNFGNSYISYWAYWGQGT LVTVSSGGGGSGGGGSGGGGSQTVVTQEPSLTVSPGGTVTLTCGSSTGAVTSGNYPNWVQQK PGQAPRGLIGGTKFLAPGTPARFSGSLLGGKAALTLSGVQPEDEAEYYCVLWYSNRWVFGGG TKLTVLPGGGSDAHKSEVAHRFKDLGEENFKALVLIAFAQYLQQCPFEDHVKLVNEVTEFA KTCVADESAENCDKSLHTLFGDKLCTVATLRETYGEMADCCAKQEPERNECFLQHKDDNPNL PRLVRPEVDVMCTAFHDNEETFLKKYLYEIARRHPYFYAPELLFFAKRYKAAFTECCQAADK AACLLPKLDELRDEGKASSAKQRLKCASLQKFGERAFKAWAVARLSQRFPKAEFAEVSKLVT DLTKVHTECCHGDLLECADDRADLAKYICENQDSISSKLKECCEKPLLEKSHCIAEVENDEM PADLPSLAADFVESKDVCKNYAEAKDVFLGMFLYEYARRHPDYSVVLLLRLAKTYETTLEKC CAAADPHECYAKVFDEFKPLVEEPQNLIKQNCELFEQLGEYKFQNALLVRYTKKVPQVSTPT LVEVSRNLGKVGSKCCKHPEAKRMPCAEDYLSVVLNQLCVLHEKTPVSDRVTKCCTESLVNR RPCFSALEVDETYVPKEFNAETFTFHADICTLSEKERQIKKQTALVELVKHKPKATKEQLKA VMDDFAAFVEKCCKADDKETCFAEEGKKLVAASQAALGLHHHHHH |
| 241 | EGF-5[6] | DLL3-21 xI2C - HALB | bispecific molecule - HALB | QVQLVQSGAEVKKPGASVKVSCKASGYAFTSYYIHWVRQAPGQGLEWMGIINPSGGSKSYAQ KFRGRVTMTRDTSTSTVYMELSSLTSEDTAVYYCARSMSTVTSDAFDIWGQGTMVTVSSGGG GSGGGGSGGGGSDIQMTQSPSSLSASVGDRVTITCRASQSISNYLNWYQQKPGKAPKLLIYA ASSLQSGVPSRFSGSGSGTDFTLTISSLQPEDFATYYCQQSYSAPLTFGGGTKVDIKSGGGG SEVQLVESGGGLVQPGGSLKLSCAASGFTFNKYAMNWVRQAPGKGLEWVARIRSKYNNYATY YADSVKDRFTISRDDSKNTAYLQMNNLKTEDTAVYYCVRHGNFGNSYISYWAYWGQGTLVTV SSGGGGSGGGGSGGGGSQTVVTQEPSLTVSPGGTVTLTCGSSTGAVTSGNYPNWVQQKPGQA PRGLIGGTKFLAPGTPARFSGSLLGGKAALTLSGVQPEDEAEYYCVLWYSNRWVFGGGTKLT VLPGGGSDAHKSEVAHRFKDLGEENFKALVLIAFAQYLQQCPFEDHVKLVNEVTEFAKTCV ADESAENCDKSLHTLFGDKLCTVATLRETYGEMADCCAKQEPERNECFLQHKDDNPNLPRLV RPEVDVMCTAFHDNEETFLKKYLYEIARRHPYFYAPELLFFAKRYKAAFTECCQAADKAACL LPKLDELRDEGKASSAKQRLKCASLQKFGERAFKAWAVARLSQRFPKAEFAEVSKLVTDLTK VHTECCHGDLLECADDRADLAKYICENQDSISSKLKECCEKPLLEKSHCIAEVENDEMPADL PSLAADFVESKDVCKNYAEAKDVFLGMFLYEYARRHPDYSVVLLLRLAKTYETTLEKCCAAA DPHECYAKVFDEFKPLVEEPQNLIKQNCELFEQLGEYKFQNALLVRYTKKVPQVSTPTLVEV SRNLGKVGSKCCKHPEAKRMPCAEDYLSVVLNQLCVLHEKTPVSDRVTKCCTESLVNRRPCF SALEVDETYVPKEFNAETFTFHADICTLSEKERQIKKQTALVELVKHKPKATKEQLKAVMDD FAAFVEKCCKADDKETCFAEEGKKLVAASQAALGLHHHHHH |
| 242 | EGF-3 | DLL3-4 xF12Q - | bispecific molecule - | QVQLQESGPGLVKPSETLSLTCTVSGGSISSYYWSWIRQPPGKGLEWIGYVYYSGTTNYNPS LKSRVTISVDTSKNQFSLKLSSVTAADTAVYYCASIAVTGFYFDYWGQGTLVTVSSGGGGSG |

TABLE 18-continued

| SEQ ID NO | DLL3-epitope | Designation | Format / Source | Amino acid sequence |
|---|---|---|---|---|
| | | HALB | HALB | GGGSGGGGSEIVLTQSPGTLSLSPGERVTLSCRASQRVNNNYLAWYQQRPGQAPRLLIYGAS SRATGIPDRFSGSGSGTDFTLTISRLEPEDFAVYYCQQYDRSPLTFGGGTKLEIKSGGGGSE VQLVESGGGLVQPGGSLRLSCAASGFTFNSYAMNWVRQAPGKGLEWVARIRSKYNNYATYYA DSVKGRFTISRDDSKNTAYLQMNSLKTEDTAVYYCVRHGNFGNSYVSWWAYWGQGTLVTVSS GGGGSGGGGSGGGGSQTVVTQEPSLTVSPGGTVTLTCGSSTGAVTSGNYPNWVQQKPGQAPR GLIGGTKFLAPGTPARFSGSLLGGKAALTLSGVQPEDEAEYYCVLWYSNRWVFGGGTKLTVL PGGGGSDAHKSEVAHRFKDLGEENFKALVLIAFAQYLQQCPFEDHVKLVNEVTEFAKTCVAD ESAENCDKSLHTLFGDKLCTVATLRETYGEMADCCAKQEPERNECFLQHKDDNPNLPRLVRP EVDVMCTAFHDNEETFLKKYLYEIARRHPYFYAPELLFFAKRYKAAFTECCQAADKAACLLP KLDELRDEGKASSAKQRLKCASLQKFGERAFKAWAVARLSQRFPKAEFAEVSKLVTDLTKVH TECCHGDLLECADDRADLAKYICENQDSISSKLKECCEKPLLEKSHCIAEVENDEMPADLPS LAADFVESKDVCKNYAEAKDVFLGMFLYEYARRHPDYSVVLLLRLAKTYETTLEKCCAAADP HECYAKVFDEFKPLVEEPQNLIKQNCELFEQLGEYKFQNALLVRYTKKVPQVSTPTLVEVSR NLGKVGSKCCKHPEAKRMPCAEDYLSVVLNQLCVLHEKTPVSDRVTKCCTESLVNRRPCFSA LEVDETYVPKEFNAETFTFHADICTLSEKERQIKKQTALVELVKHKPKATKEQLKAVMDDFA AFVEKCCKADDKETCFAEEGKKLVAASQAALGLHHHHHH |
| 243 | EGF-3 | DLL3-5 xF12Q - HALB | bispecific molecule - HALB | QVQLQESGPGLVKPSETLSLTCTVSGGSISSYYWSWIRQPPGKGLEWIGYIYYSGRTNYYPS LKSRVTISIDTSKNQFSLKLSSVTAADTAVYYCARIAVAGFFFDYWGQGTLVTVSSGGGGGS GGGGSGGGGSEIVLTQSPGTLSLSPGERATLSCRASQSVNKNYLAWYQQKPGQAPRLLIYGAS SRATGIPDRFSGSGSGTDFTLTISRLEPEDFAVYYCQQYDRSPLTFGGGTKLEIKSGGGGSE VQLVESGGGLVQPGGSLRLSCAASGFTFNSYAMNWVRQAPGKGLEWVARIRSKYNNYATYYA DSVKGRFTISRDDSKNTAYLQMNSLKTEDTAVYYCVRHGNFGNSYVSWWAYWGQGTLVTVSS GGGGSGGGGSGGGGSQTVVTQEPSLTVSPGGTVTLTCGSSTGAVTSGNYPNWVQQKPGQAPR GLIGGTKFLAPGTPARFSGSLLGGKAALTLSGVQPEDEAEYYCVLWYSNRWVFGGGTKLTVL PGGGGSDAHKSEVAHRFKDLGEENFKALVLIAFAQYLQQCPFEDHVKLVNEVTEFAKTCVAD ESAENCDKSLHTLFGDKLCTVATLRETYGEMADCCAKQEPERNECFLQHKDDNPNLPRLVRP EVDVMCTAFHDNEETFLKKYLYEIARRHPYFYAPELLFFAKRYKAAFTECCQAADKAACLLP KLDELRDEGKASSAKQRLKCASLQKFGERAFKAWAVARLSQRFPKAEFAEVSKLVTDLTKVH TECCHGDLLECADDRADLAKYICENQDSISSKLKECCEKPLLEKSHCIAEVENDEMPADLPS LAADFVESKDVCKNYAEAKDVFLGMFLYEYARRHPDYSVVLLLRLAKTYETTLEKCCAAADP HECYAKVFDEFKPLVEEPQNLIKQNCELFEQLGEYKFQNALLVRYTKKVPQVSTPTLVEVSR NLGKVGSKCCKHPEAKRMPCAEDYLSVVLNQLCVLHEKTPVSDRVTKCCTESLVNRRPCFSA LEVDETYVPKEFNAETFTFHADICTLSEKERQIKKQTALVELVKHKPKATKEQLKAVMDDFA AFVEKCCKADDKETCFAEEGKKLVAASQAALGLHHHHHH |
| 244 | EGF-3 | DLL3-6 xF12Q - HALB | bispecific molecule - HALB | QVQLQESGPGLVKPSETLSLTCTVSGASISSFYWSWIRQPPGKGLEWIGYIYYSGTTNYNPS LKSRVTISVDTSKNQFSLKLSSVTAADTAVYYCARIAVAGFFFDYWGQGTLVTVSSGGGGGS GGGGSGGGGSEIVLTQSPGTLSLSPGERATLSCRASQSVNKNYLAWYQQKPGQAPRLLIYGAS SRATGIPDRFSGSGSGTDFTLTISRLEPEDFAVYYCQQYDRSPLTFGGGTKVEIKSGGGGSE VQLVESGGGLVQPGGSLRLSCAASGFTFNSYAMNWVRQAPGKGLEWVARIRSKYNNYATYYA DSVKGRFTISRDDSKNTAYLQMNSLKTEDTAVYYCVRHGNFGNSYVSWWAYWGQGTLVTVSS GGGGSGGGGSGGGGSQTVVTQEPSLTVSPGGTVTLTCGSSTGAVTSGNYPNWVQQKPGQAPR GLIGGTKFLAPGTPARFSGSLLGGKAALTLSGVQPEDEAEYYCVLWYSNRWVFGGGTKLTVL PGGGGSDAHKSEVAHRFKDLGEENFKALVLIAFAQYLQQCPFEDHVKLVNEVTEFAKTCVAD ESAENCDKSLHTLFGDKLCTVATLRETYGEMADCCAKQEPERNECFLQHKDDNPNLPRLVRP EVDVMCTAFHDNEETFLKKYLYEIARRHPYFYAPELLFFAKRYKAAFTECCQAADKAACLLP KLDELRDEGKASSAKQRLKCASLQKFGERAFKAWAVARLSQRFPKAEFAEVSKLVTDLTKVH TECCHGDLLECADDRADLAKYICENQDSISSKLKECCEKPLLEKSHCIAEVENDEMPADLPS LAADFVESKDVCKNYAEAKDVFLGMFLYEYARRHPDYSVVLLLRLAKTYETTLEKCCAAADP HECYAKVFDEFKPLVEEPQNLIKQNCELFEQLGEYKFQNALLVRYTKKVPQVSTPTLVEVSR NLGKVGSKCCKHPEAKRMPCAEDYLSVVLNQLCVLHEKTPVSDRVTKCCTESLVNRRPCFSA LEVDETYVPKEFNAETFTFHADICTLSEKERQIKKQTALVELVKHKPKATKEQLKAVMDDFA AFVEKCCKADDKETCFAEEGKKLVAASQAALGLHHHHHH |
| 245 | EGF-3 | DLL3-7 xF12Q - HALB | bispecific molecule - HALB | QVQLQESGPGLVKPSQTLSLTCTVSGASISSFYWSWIRQPPGKGLEWIGYIYYSGTTNYNPS LKSRVTISVDTSKNQFSLKLSSVTAADTAVYYCARIAVAGFFFDYWGQGTLVTVSSGGGGGS GGGGSGGGGSEIVLTQSPGTLSLSPGERATLSCRASQSVNKNYLAWYQQKPGQAPRLLIYGAS SRATGIPDRFSGSGSGTDFTLTISRLEPEDFAVYYCQQYDRSPLTFGGGTKVEIKSGGGGSE VQLVESGGGLVQPGGSLRLSCAASGFTFNSYAMNWVRQAPGKGLEWVARIRSKYNNYATYYA DSVKGRFTISRDDSKNTAYLQMNSLKTEDTAVYYCVRHGNFGNSYVSWWAYWGQGTLVTVSS GGGGSGGGGSGGGGSQTVVTQEPSLTVSPGGTVTLTCGSSTGAVTSGNYPNWVQQKPGQAPR GLIGGTKFLAPGTPARFSGSLLGGKAALTLSGVQPEDEAEYYCVLWYSNRWVFGGGTKLTVL PGGGGSDAHKSEVAHRFKDLGEENFKALVLIAFAQYLQQCPFEDHVKLVNEVTEFAKTCVAD ESAENCDKSLHTLFGDKLCTVATLRETYGEMADCCAKQEPERNECFLQHKDDNPNLPRLVRP EVDVMCTAFHDNEETFLKKYLYEIARRHPYFYAPELLFFAKRYKAAFTECCQAADKAACLLP KLDELRDEGKASSAKQRLKCASLQKFGERAFKAWAVARLSQRFPKAEFAEVSKLVTDLTKVH TECCHGDLLECADDRADLAKYICENQDSISSKLKECCEKPLLEKSHCIAEVENDEMPADLPS LAADFVESKDVCKNYAEAKDVFLGMFLYEYARRHPDYSVVLLLRLAKTYETTLEKCCAAADP HECYAKVFDEFKPLVEEPQNLIKQNCELFEQLGEYKFQNALLVRYTKKVPQVSTPTLVEVSR NLGKVGSKCCKHPEAKRMPCAEDYLSVVLNQLCVLHEKTPVSDRVTKCCTESLVNRRPCFSA LEVDETYVPKEFNAETFTFHADICTLSEKERQIKKQTALVELVKHKPKATKEQLKAVMDDFA AFVEKCCKADDKETCFAEEGKKLVAASQAALGLHHHHHH |
| 246 | EGF-3 | DLL3-8 xF12Q - | bispecific molecule - | QVQLQEWGPGLVKPSETLSLTCTVSGASISSFYWSWIRQPPGKGLEWIGYIYYSGTTNYNPS LKSRVTISVDTSKNQFSLKLSSVTAADTAVYYCARIAVAGFFFDYWGQGTLVTVSSGGGGGS |

TABLE 18-continued

| SEQ ID NO | DLL3-epitope | Designation | Format / Source | Amino acid sequence |
|---|---|---|---|---|
| | | HALB | HALB | GGGSGGGGSEIVLTQSPGTLSLSPGERATLSCRASQSVNKNYLAWYQQKPGQAPRLLIYGAS SRATGIPDRFSGSGSGTDFTLTISRLEPEDFAVYYCQQYDRSPLTFGGGTKVDIKSGGGGSE VQLVESGGGLVQPGGSLRLSCAASGFTFNSYAMNWVRQAPGKGLEWVARIRSKYNNYATYYA DSVKGRFTISRDDSKNTAYLQMNSLKTEDTAVYYCVRHGNFGNSYVSWWAYWGQGTLVTVSS GGGGSGGGGSGGGGSQTVVTQEPSLTVSPGGTVTLTCGSSTGAVTSGNYPNWVQQKPGQAPR GLIGGTKFLAPGTPARFSGSLLGGKAALTLSGVQPEDEAEYYCVLWYSNRWVFGGGTKLTVL PGGGGSDAHKSEVAHRFKDLGEENFKALVLIAFAQYLQQCPFEDHVKLVNEVTEFAKTCVAD ESAENCDKSLHTLFGDKLCTVATLRETYGEMADCCAKQEPERNECFLQHKDDNPNLPRLVRP EVDVMCTAFHDNEETFLKKYLYEIARRHPYFYAPELLFFAKRYKAAFTECCQAADKAACLLP KLDELRDEGKASSAKQRLKCASLQKFGERAFKAWAVARLSQRFPKAEFAEVSKLVTDLTKVH TECCHGDLLECADDRADLAKYICENQDSISSKLKECCEKPLLEKSHCIAEVENDEMPADLPS LAADFVESKDVCKNYAEAKDVFLGMFLYEYARRHPDYSVVLLLRLAKTYETTLEKCCAAADP HECYAKVFDEFKPLVEEPQNLIKQNCELFEQLGEYKFQNALLVRYTKKVPQVSTPTLVEVSR NLGKVGSKCCKHPEAKRMPCAEDYLSVVLNQLCVLHEKTPVSDRVTKCCTESLVNRRPCFSA LEVDETYVPKEFNAETFTFHADICTLSEKERQIKKQTALVELVKHKPKATKEQLKAVMDDFA AFVEKCCKADDKETCFAEEGKKLVAASQAALGLHHHHHH |
| 247 | EGF-3 | DLL3-9 xF12Q - HALB | bispecific molecule - HALB | QVQLQESGPGLVKPSETLSLTCTVSGASISSFYWSWIRQPPGKGLEWIGYIYYSGTTNYNPS LKSRVTISVDTSKNQFSLKLSSVTAADTAVYYCARIAVAGFFFDYWGQGTLVTVSSGGGGSG GGGSGGGGSEIVLTQSPGTLSLSPGESATLSCRASQSVNKNYLAWYQQKPGQAPRLLIYGAS SRATGIPDRFSGSGSGTDFTLTISRLEPEDFAVYYCQQYDRSPLTFGGGTRLEIKSGGGGSE VQLVESGGGLVQPGGSLRLSCAASGFTFNSYAMNWVRQAPGKGLEWVARIRSKYNNYATYYA DSVKGRFTISRDDSKNTAYLQMNSLKTEDTAVYYCVRHGNFGNSYVSWWAYWGQGTLVTVSS GGGGSGGGGSGGGGSQTVVTQEPSLTVSPGGTVTLTCGSSTGAVTSGNYPNWVQQKPGQAPR GLIGGTKFLAPGTPARFSGSLLGGKAALTLSGVQPEDEAEYYCVLWYSNRWVFGGGTKLTVL PGGGGSDAHKSEVAHRFKDLGEENFKALVLIAFAQYLQQCPFEDHVKLVNEVTEFAKTCVAD ESAENCDKSLHTLFGDKLCTVATLRETYGEMADCCAKQEPERNECFLQHKDDNPNLPRLVRP EVDVMCTAFHDNEETFLKKYLYEIARRHPYFYAPELLFFAKRYKAAFTECCQAADKAACLLP KLDELRDEGKASSAKQRLKCASLQKFGERAFKAWAVARLSQRFPKAEFAEVSKLVTDLTKVH TECCHGDLLECADDRADLAKYICENQDSISSKLKECCEKPLLEKSHCIAEVENDEMPADLPS LAADFVESKDVCKNYAEAKDVFLGMFLYEYARRHPDYSVVLLLRLAKTYETTLEKCCAAADP HECYAKVFDEFKPLVEEPQNLIKQNCELFEQLGEYKFQNALLVRYTKKVPQVSTPTLVEVSR NLGKVGSKCCKHPEAKRMPCAEDYLSVVLNQLCVLHEKTPVSDRVTKCCTESLVNRRPCFSA LEVDETYVPKEFNAETFTFHADICTLSEKERQIKKQTALVELVKHKPKATKEQLKAVMDDFA AFVEKCCKADDKETCFAEEGKKLVAASQAALGLHHHHHH |
| 248 | EGF-3 | DLL3-10 xF12Q - HALB | bispecific molecule - HALB | QVQLQESGPGLVKPSQTLSLTCTVSGGSISSYYWSWIRQPPGKGLEWIGYIFYNGITNYNPS LKSRVTISLDTSKNQFSLKLSSVTAADTAKYYCARISGSFSFDYWDQGTLVTVSSGGGGSG GGGSGGGGSEIVMTQSPGTLSLSPGERATLSCRASQSVSRGYLAWYQQKPGQAPRLLIYGAS SRATDIPDRFSGSGSGTDFTLTISRLEPEDFAVYYCQQYDTSPITFGQGTKVEIKSGGGGSE VQLVESGGGLVQPGGSLRLSCAASGFTFNSYAMNWVRQAPGKGLEWVARIRSKYNNYATYYA DSVKGRFTISRDDSKNTAYLQMNSLKTEDTAVYYCVRHGNFGNSYVSWWAYWGQGTLVTVSS GGGGSGGGGSGGGGSQTVVTQEPSLTVSPGGTVTLTCGSSTGAVTSGNYPNWVQQKPGQAPR GLIGGTKFLAPGTPARFSGSLLGGKAALTLSGVQPEDEAEYYCVLWYSNRWVFGGGTKLTVL PGGGGSDAHKSEVAHRFKDLGEENFKALVLIAFAQYLQQCPFEDHVKLVNEVTEFAKTCVAD ESAENCDKSLHTLFGDKLCTVATLRETYGEMADCCAKQEPERNECFLQHKDDNPNLPRLVRP EVDVMCTAFHDNEETFLKKYLYEIARRHPYFYAPELLFFAKRYKAAFTECCQAADKAACLLP KLDELRDEGKASSAKQRLKCASLQKFGERAFKAWAVARLSQRFPKAEFAEVSKLVTDLTKVH TECCHGDLLECADDRADLAKYICENQDSISSKLKECCEKPLLEKSHCIAEVENDEMPADLPS LAADFVESKDVCKNYAEAKDVFLGMFLYEYARRHPDYSVVLLLRLAKTYETTLEKCCAAADP HECYAKVFDEFKPLVEEPQNLIKQNCELFEQLGEYKFQNALLVRYTKKVPQVSTPTLVEVSR NLGKVGSKCCKHPEAKRMPCAEDYLSVVLNQLCVLHEKTPVSDRVTKCCTESLVNRRPCFSA LEVDETYVPKEFNAETFTFHADICTLSEKERQIKKQTALVELVKHKPKATKEQLKAVMDDFA AFVEKCCKADDKETCFAEEGKKLVAASQAALGLHHHHHH |
| 249 | EGF-4 | DLL3-13 xF12Q - HALB | bispecific molecule - HALB | QVQLVQSGAEVKKPGASVKVSCKASGYTFTSYYMHWVRQAPGQGLEWMGIINPSDGSTNYAQ NFQGRVTMTRDTSTNTVYMELSSLRSEDTAVYYCARGGNSAFYSYYDMDVWGQGTTVTVSSG GGGSGGGGSGGGGSDVVMTQSPLSLPVTLGQPASISCRSSQSLVYRDGNTYLSWFQQRPGQS PRRLIYKVSNWQSGVPDRFSGSGSGTHWPPTFGQGTKVE IKSGGGGSEVQLVESGGGLVQPGGSLRLSCAASGFTFNSYAMNWVRQAPGKGLEWVARIRSK YNNYATYYADSVKGRFTISRDDSKNTAYLQMNSLKTEDTAVYYCVRHGNFGNSYVSWWAYWG QGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVF GGGTKLTVLPGGGGSDAHKSEVAHRFKDLGEENFKALVLIAFAQYLQQCPFEDHVKLVNEVT EFAKTCVADESAENCDKSLHTLFGDKLCTVATLRETYGEMADCCAKQEPERNECFLQHKDDN PNLPRLVRPEVDVMCTAFHDNEETFLKKYLYEIARRHPYFYAPELLFFAKRYKAAFTECCQA ADKAACLLPKLDELRDEGKASSAKQRLKCASLQKFGERAFKAWAVARLSQRFPKAEFAEVSK LVTDLTKVHTECCHGDLLECADDRADLAKYICENQDSISSKLKECCEKPLLEKSHCIAEVEN DEMPADLPSLAADFVESKDVCKNYAEAKDVFLGMFLYEYARRHPDYSVVLLLRLAKTYETTL EKCCAAADPHECYAKVFDEFKPLVEEPQNLIKQNCELFEQLGEYKFQNALLVRYTKKVPQVS TPTLVEVSRNLGKVGSKCCKHPEAKRMPCAEDYLSVVLNQLCVLHEKTPVSDRVTKCCTESL VNRRPCFSALEVDETYVPKEFNAETFTFHADICTLSEKERQIKKQTALVELVKHKPKATKEQ LKAVMDDFAAFVEKCCKADDKETCFAEEGKKLVAASQAALGLHHHHHH |
| 250 | EGF-4 | DLL3-14 xF12Q - | bispecific molecule - | QVQLVQSGAEVKKPGASVKVSCKASGYTFTNYYMHWVRQAPGLGLEWMGIINPSDGSTSYAQ KFQGRVTMTRDTSTNTVYMDLSSLRSEDTAVYYCARGGNSAFYSYYDMDVWGQGTTVTVSSG |

TABLE 18-continued

| SEQ ID NO | DLL3-epitope | Designation | Format / Source | Amino acid sequence |
|---|---|---|---|---|
| | | HALB | HALB | GGGSGGGGSGGGGSDVVMTQTPLSLPVTLGQPASISCRSSQSLVYRDGNTYLSWFQQRPGQS PRRLIYKVSNWQSGVPDRFSGGGSGTDFTLKISRVEAEDVGVYYCMQGTHWPPTFGQGTKVE IKSGGGGSEVQLVESGGGLVQPGGSLRLSCAASGFTFNSYAMNWVRQAPGKGLEWVARIRSK YNNYATYYADSVKGRFTISRDDSKNTAYLQMNSLKTEDTAVYYCVRHGNFGNSYVSWWAYWG QGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVF GGGTKLTVLPGGGSDAHKSEVAHRFKDLGEENFKALVLIAFAQYLQQCPFEDHVKLVNEVT EFAKTCVADESAENCDKSLHTLFGDKLCTVATLRETYGEMADCCAKQEPERNECFLQHKDDN PNLPRLVRPEVDVMCTAFHDNEETFLKKYLYEIARRHPYFYAPELLFFAKRYKAAFTECCQA ADKAACLLPKLDELRDEGKASSAKQRLKCASLQKFGERAFKAWAVARLSQRFPKAEFAEVSK LVTDLTKVHTECCHGDLLECADDRADLAKYICENQDSISSKLKECCEKPLLEKSHCIAEVEN DEMPADLPSLAADFVESKDVCKNYAEAKDVFLGMFLYEYARRHPDYSVVLLLRLAKTYETTL EKCCAAADPHECYAKVFDEFKPLVEEPQNLIKQNCELFEQLGEYKFQNALLVRYTKKVPQVS TPTLVEVSRNLGKVGSKCCKHPEAKRMPCAEDYLSVVLNQLCVLHEKTPVSDRVTKCCTESL VNRRPCFSALEVDETYVPKEFNAETFTFHADICTLSEKERQIKKQTALVELVKHKPKATKEQ LKAVMDDFAAFVEKCCKADDKETCFAEEGKKLVAASQAALGLHHHHHH |
| 251 | EGF-4 | DLL3-15 xF12Q - HALB | bispecific molecule - HALB | QVQLVQSGAEVKKPGASVKVSCKASGYTFTGYYIHWVRQAPGQGLEWMGIINPSDGSTSYGQ NFQGRVTMTRDTSTNTVYMELSSLRSEDTAVYYCARGGNSAFYSYYDMDVWGQGTTVTVSSG GGGSGGGGSGGGGSDVVMTQSPLSLPVTLGQPASISCRSSQSLAYRDGNTYLSWFQQRPGQS PRRLIYKVSNWQSGVPDRFSGSGSGTDFTLKISRVEAEDVGVYYCMQGTHWPPTFGQGTKVE IKSGGGGSEVQLVESGGGLVQPGGSLRLSCAASGFTFNSYAMNWVRQAPGKGLEWVARIRSK YNNYATYYADSVKGRFTISRDDSKNTAYLQMNSLKTEDTAVYYCVRHGNGNSYVSWWAYWG QGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVF GGGTKLTVLPGGGSDAHKSEVAHRFKDLGEENFKALVLIAFAQYLQQCPFEDHVKLVNEVT EFAKTCVADESAENCDKSLHTLFGDKLCTVATLRETYGEMADCCAKQEPERNECFLQHKDDN PNLPRLVRPEVDVMCTAFHDNEETFLKKYLYEIARRHPYFYAPELLFFAKRYKAAFTECCQA ADKAACLLPKLDELRDEGKASSAKQRLKCASLQKFGERAFKAWAVARLSQRFPKAEFAEVSK LVTDLTKVHTECCHGDLLECADDRADLAKYICENQDSISSKLKECCEKPLLEKSHCIAEVEN DEMPADLPSLAADFVESKDVCKNYAEAKDVFLGMFLYEYARRHPDYSVVLLLRLAKTYETTL EKCCAAADPHECYAKVFDEFKPLVEEPQNLIKQNCELFEQLGEYKFQNALLVRYTKKVPQVS TPTLVEVSRNLGKVGSKCCKHPEAKRMPCAEDYLSVVLNQLCVLHEKTPVSDRVTKCCTESL VNRRPCFSALEVDETYVPKEFNAETFTFHADICTLSEKERQIKKQTALVELVKHKPKATKEQ LKAVMDDFAAFVEKCCKADDKETCFAEEGKKLVAASQAALGLHHHHHH |
| 252 | — | Human DLL3 | human | MVSPRMSGLLSQTVILALIFLPQTRPAGVFELQIHSFGPGPGPGAPRSPCSARLPCRLFFRV CLKPGLSEEAAESPCALGAALSARGPVYTEQPGAPAPDLPLPDGLLQVPFRDAWPGTFSFII ETWREELGDQIGGPAWSLLARVAGRRRLAAGGPWARDIQRAGAWELRFSYRARCEPPAVGTA CTRLCRPRSAPSRCGPGLRPCAPLEDECEAPLVCRAGCSPEHGFCEQPGECRCLEGWTGPLC TVPVSTSSCLSPRGPSSATTGCLVPGPGPCDGNPCANGGSCSETPRSFECTCPRGFYGLRCE VSGVTCADGPCFNGGLCVGGADPDSAYICHCPPGFQGSNCEKRVDRCSLQPCRNGGLCLDLG HALRCRCRAGFAGPRCEHDLDDCAGRACANGGTCVEGGGAHRCSCALGFGGRDCRERADPCA ARPCAHGGRCYAHFSGLVCACAPGYMGARCEFPVHPDGASALPAAPPGLRPGDPQRYLLPPA LGLLVAAGVAGAALLLVHVRRRGHSQDAGSRLLAGTPEPSVHALPDALNNLRTQEGSGDGPS SSVDWNRPEDVDPQGIYVISAPSIYAREVATPLFPPLHTGRAGQRHLLFPYPSSILSVK |
| 253 | — | Human DLL3 ECD | human | MVSPRMSGLLSQTVILALIFLPQTRPAGVFELQIHSFGPGPGPGAPRSPCSARLPCRLFFRV CLKPGLSEEAAESPCALGAALSARGPVYTEQPGAPAPDLPLPDGLLQVPFRDAWPGTFSFII ETWREELGDQIGGPAWSLLARVAGRRRLAAGGPWARDIQRAGAWELRFSYRARCEPPAVGTA CTRLCRPRSAPSRCGPGLRPCAPLEDECEAPLVCRAGCSPEHGFCEQPGECRCLEGWTGPLC TVPVSTSSCLSPRGPSSATTGCLVPGPGPCDGNPCANGGSCSETPRSFECTCPRGFYGLRCE VSGVTCADGPCFNGGLCVGGADPDSAYICHCPPGFQGSNCEKRVDRCSLQPCRNGGLCLDLG HALRCRCRAGFAGPRCEHDLDDCAGRACANGGTCVEGGGAHRCSCALGFGGRDCRERADPCA ARPCAHGGRCYAHFSGLVCACAPGYMGARCEFPVHPDGASALPAAPPGLRPGDPQRYL |
| 254 | — | Hu DLL3 N-term. | human | MVSPRMSGLLSQTVILALIFLPQTRPAGVFELQIHSFGPGPGPGAPRSPCSARLPCRLFFRV CLKPGLSEEAAESPCALGAALSARGPVYTEQPGAPAPDLPLPDGLLQVPFRDAWPGTFSFII ETWREELGDQIGGPAWSLLARVAGRRRLAAGGPWARDIQRAGAWELRFSYR |
| 255 | — | Hu DLL3 DSL dom | human | ARCEPPAVGTACTRLCRPRSAPSRCGPGLRPCAPLEDECE |
| 256 | — | Hu DLL3 EGF-1 | human | APLVCRAGCSPEHGFCEQPGECRCLEGWTGPLCT |
| 257 | — | Hu DLL3 EGF-2 | human | GPGPCDGNPCANGGSCSETPRSFECTCPRGFYGLRCE |
| 258 | — | Hu DLL3 EGF-3 | human | SGVTCADGPCFNGGLCVGGADPDSAYICHCPPGFQGSNCE |
| 259 | — | Hu DLL3 EGF-4 | human | RVDRCSLQPCRNGGLCLDLGHALRCRCRAGFAGPRCE |

TABLE 18-continued

| SEQ ID NO | DLL3-epitope | Designation | Format / Source | Amino acid sequence |
|---|---|---|---|---|
| 260 | — | Hu DLL3 EGF-3 + 4 | human | SGVTCADGPCFNGGLCVGGADPDSAYICHCPPGFQGSNCEKRVDRCSLQPCRNGGLCLDLGH ALRCRCRAGFAGPRCE |
| 261 | — | Hu DLL3 EGF-5 | human | DLDDCAGRACANGGTCVEGGGAHRCSCALGFGGRDCR |
| 262 | — | Hu DLL3 EGF-6 | human | RADPCAARPCAHGGRCYAHFSGLVCACAPGYMGARCE |
| 263 | — | Human DLL3 ECD x EpCAM | artificial | MVSPRMSGLLSQTVILALIFLPQTRPAGVFELQIHSFGPGPGPGAPRSPCSARLPCRLFFRV CLKPGLSEEAAESPCALGAALSARGPVYTEQPGAPAPDLPLPDGLLQVPFRDAWPGTFSFII ETWREELGDQIGGPAWSLLRVAGRRRLAAGGPWARDIQRAGAWELRFSYRARCEPPAVGTA CTRLCRPRSAPSRCGPGLRPCAPLEDECEAPLVCRAGCSPEHGFCEQPGECRCLEGWTGPLC TVPVSTSSCLSPRGPSSATTGCLVPGPGPCDGNPCANGGSCSETPRSFECTCPRGFYGLRCE VSGVTCADGPCFNGGLCVGGADPDSAYICHCPPGFQGSNCEKRVDRCSLQPCRNGGLCLDLG HALRCRCRAGFAGPRCEHDLDDCAGRACANGGTCVEGGGAHRCSCALGFGGRDCRERADPCA ARPCAHGGRCYAHFSGLVCACAPGYMGARCEFPVHPDGASALPAAPPGLRPGDPQRYLSGGG GSGAGVIAVIVVVIAIVAGIVVLVISRKKRMAKYEKAEIKEMGEMHRELNA |
| 264 | — | V5 x hu DLL3 DSL x EpCAM | artificial | MGWSCIILFLVATATGVHSGKPIPNPLLGLDSTSGARCEPPAVGTACTRLCRPRSAPSRCGP GLRPCAPLEDECEAPLVCRAGCSPEHGFCEQPGECRCLEGWTGPLCTVPVSTSSCLSPRGPS SATTGCLVPGPGPCDGNPCANGGSCSETPRSFECTCPRGFYGLRCEVSGVTCADGPCFNGGL CVGGADPDSAYICHCPPGFQGSNCEKRVDRCSLQPCRNGGLCLDLGHALRCRCRAGFAGPRC EHDLDDCAGRACANGGTCVEGGGAHRCSCALGFGGRDCRERADPCAARPCAHGGRCYAHFSG LVCACAPGYMGARCEFPVHPDGASALPAAPPGLRPGDPQRYLSGGGGSGAGVIAVIVVVIA IVAGIVVLVISRKKRMAKYEKAEIKEMGEMHRELNA |
| 265 | — | V5 x hu DLL3-EGF1 x EpCAM | artificial | MGWSCIILFLVATATGVHSGKPIPNPLLGLDSTSGAPLVCRAGCSPEHGFCEQPGECRCLEG WTGPLCTVPVSTSSCLSPRGPSSATTGCLVPGPGPCDGNPCANGGSCSETPRSFECTCPRGF YGLRCEVSGVTCADGPCFNGGLCVGGADPDSAYICHCPPGFQGSNCEKRVDRCSLQPCRNGG LCLDLGHALRCRCRAGFAGPRCEHDLDDCAGRACANGGTCVEGGGAHRCSCALGFGGRDCRE RADPCAARPCAHGGRCYAHFSGLVCACAPGYMGARCEFPVHPDGASALPAAPPGLRPGDPQR YLSGGGGSGAGVIAVIVVVIAIVAGIVVLVISRKKRMAKYEKAEIKEMGEMHRELNA |
| 266 | — | V5 x hu DLL3-EGF2 x EpCAM | artificial | MGWSCIILFLVATATGVHSGKPIPNPLLGLDSTSGGPGPCDGNPCANGGSCSETPRSFECTC PRGFYGLRCEVSGVTCADGPCFNGGLCVGGADPDSAYICHCPPGFQGSNCEKRVDRCSLQPC RNGGLCLDLGHALRCRCRAGFAGPRCEHDLDDCAGRACANGGTCVEGGGAHRCSCALGFGGR DCRERADPCAARPCAHGGRCYAHFSGLVCACAPGYMGARCEFPVHPDGASALPAAPPGLRPG DPQRYLSGGGGSGAGVIAVIVVVIAIVAGIVVLVISRKKRMAKYEKAEIKEMGEMHRELNA |
| 267 | — | V5 x hu DLL3-EGF3 x EpCAM | artificial | MGWSCIILFLVATATGVHSGKPIPNPLLGLDSTSGSGVTCADGPCFNGGLCVGGADPDSAYI CHCPPGFQGSNCEKRVDRCSLQPCRNGGLCLDLGHALRCRCRAGFAGPRCEHDLDDCAGRAC ANGGTCVEGGGAHRCSCALGFGGRDCRERADPCAARPCAHGGRCYAHFSGLVCACAPGYMGA RCEFPVHPDGASALPAAPPGLRPGDPQRYLSGGGGSGAGVIAVIVVVIAIVAGIVVLVISR KKRMAKYEKAEIKEMGEMHRELNA |
| 268 | — | V5 x hu DLL3-EGF4 x EpCAM | artificial | MGWSCIILFLVATATGVHSGKPIPNPLLGLDSTSGRVDRCSLQPCRNGGLCLDLGHALRCRC RAGFAGPRCEHDLDDCAGRACANGGTCVEGGGAHRCSCALGFGGRDCRERADPCAARPCAHG GRCYAHFSGLVCACAPGYMGARCEFPVHPDGASALPAAPPGLRPGDPQRYLSGGGGSGAGVI AVIVVVIAIVAGIVVLVISRKKRMAKYEKAEIKEMGEMHRELNA |
| 269 | — | V5 x hu DLL3-EGF5 x EpCAM | artificial | MGWSCIILFLVATATGVHSGKPIPNPLLGLDSTSGDLDDCAGRACANGGTCVEGGGAHRCSC ALGFGGRDCRERADPCAARPCAHGGRCYAHFSGLVCACAPGYMGARCEFPVHPDGASALPAA PPGLRPGDPQRYLSGGGGSGAGVIAVIVVVIAIVAGIVVLVISRKKRMAKYEKAEIKEMGE MHRELNA |
| 270 | — | V5 x hu DLL3-EGF6 x EpCAM | artificial | MGWSCIILFLVATATGVHSGKPIPNPLLGLDSTSGRADPCAARPCAHGGRCYAHFSGLVCAC APGYMGARCEFPVHPDGASALPAAPPGLRPGDPQRYLSGGGGSGAGVIAVIVVVIAIVAGI VVLVISRKKRMAKYEKAEIKEMGEMHRELNA |
| 271 | — | Macaque DLL3 | cyno | MVSPRMSRLLSQTVILALIFIPQARPAGVFELQIHSFGPGPGPGAPRSPCSARGPCRLFFRV CLKPGLSEEAAESPCALGAALSARGPVYTEQPEAPAPDLPLPNGLLQVPFRDAWPGTFSLII ETWREELGDQIGGPAWSLLRVTRRRRLAAGGPWARDIQRAGAWELRFSYRARCELPAVGTA CTRLCRPRSAPSRCGPGLRPCAPLEDECEAPPVCRAGCSLEHGFCEQPGECRCLEGWTGPLC MVPASTSSCLGLRGPSSATTGCLVPGPGPCDGNPCANGGSCSETPGSFECTCPRGFYGLRCE VSGVTCADGPCFNGGLCVGGADPDSAYICHCPPGFQGSNCEKRVDRCSLQPCRNGGLCLDLG HALRCRCRAGFAGPRCEHNLDDCAGRACANGGTCVEGGGAHRCSCALGFGGRDCRERADPCA ARPCAHGGRCYAHFSGLVCACAPGYMGSRCEFPVHPDGVSALPAAPPGLRPGDPQRYLLPPA LGLLVAAGVAGAALLLVHVRRRGHAQDAGSRLLAGTPEPSVHALPDALNNQRTQEGPGDVPS SSVDWNRPEDVDSRGIYVISAPSIYAREA |
| 272 | — | Macaque DLL3 ECD | cyno | MVSPRMSRLLSQTVILALIFIPQARPAGVFELQIHSFGPGPGPGAPRSPCSARGPCRLFFRV CLKPGLSEEAAESPCALGAALSARGPVYTEQPEAPAPDLPLPNGLLQVPFRDAWPGTFSLII ETWREELGDQIGGPAWSLLRVTRRRRLAAGGPWARDIQRAGAWELRFSYRARCELPAVGTA CTRLCRPRSAPSRCGPGLRPCAPLEDECEAPPVCRAGCSLEHGFCEQPGECRCLEGWTGPLC |

TABLE 18-continued

| SEQ ID NO | DLL3-epitope | Designation | Format / Source | Amino acid sequence |
|---|---|---|---|---|
| | | | | MVPASTSSCLGLRGPSSATTGCLVPGPGPCDGNPCANGGSCSETPGSFECTCPRGFYGLRCE VSGVTCADGPCFNGGLCVGGADPDSAYICHCPPGFQGSNCEKRVDRCSLQPCRNGGLCLDLG HALRCRCRAGFAGPRCEHNLDDCAGRACANGGTCVEGGGAHRCSCALGFGGRDCRERADPCA ARPCAHGGRCYAHFSGLVCACAPGYMGSRCEFPVHPDGVSALPAAPPGLRPGDPQRYL |
| 273 | — | Ma DLL3 N-term. | cyno | MVSPRMSRLLSQTVILALIFIPQARPAGVFELQIHSFGPGPGPGAPRSPCSARGPCRLFFRV CLKPGLSEEAAESPCALGAALSARGPVYTEQPEAPAPDLPLPNGLLQVPFRDAWPGTFSLII ETWREELGDQIGGPAWSLLARVTRRRLAAGGPWARDIQRAGAWELRFSYR |
| 274 | — | Ma DLL3 DSL dom. | cyno | ARCELPAVGTACTRLCRPRSAPSRCGPGLRPCAPLEDECE |
| 275 | — | Ma DLL3 EGF-1 | cyno | APPVCRAGCSLEHGFCEQPGECRCLEGWTGPLCM |
| 276 | — | Ma DLL3 EGF-2 | cyno | GPGPCDGNPCANGGSCSETPGSFECTCPRGFYGLRCE |
| 277 | — | Ma DLL3 EGF-3 | cyno | SGVTCADGPCFNGGLCVGGADPDSAYICHCPPGFQGSNCE |
| 278 | — | Ma DLL3 EGF-4 | cyno | RVDRCSLQPCRNGGLCLDLGHALRCRCRAGFAGPRCE |
| 279 | — | Ma DLL3 EGF-3 + 4 | cyno | SGVTCADGPCFNGGLCVGGADPDSAYICHCPPGFQGSNCEKRVDRCSLQPCRNGGLCLDLGH ALRCRCRAGFAGPRCE |
| 280 | — | Ma DLL3 EGF-5 | cyno | NLDDCAGRACANGGTCVEGGGAHRCSCALGFGGRDCR |
| 281 | — | Ma DLL3 EGF-6 | cyno | RADPCAARPCAHGGRCYAHFSGLVCACAPGYMGSRCE |
| 282 | — | Ma DLL3 ECD x EpCAM | artificial | MVSPRMSRLLSQTVILALIFIPQARPAGVFELQIHSFGPGPGPGAPRSPCSARGPCRLFFRV CLKPGLSEEAAESPCALGAALSARGPVYTEQPEAPAPDLPLPNGLLQVPFRDAWPGTFSLII ETWREELGDQIGGPAWSLLARVTRRRLAAGGPWARDIQRAGAWELRFSYRARCELPAVGTA CTRLCRPRSAPSRCGPGLRPCAPLEDECEAPPVCRAGCSLEHGFCEQPGECRCLEGWTGPLC MVPASTSSCLGLRGPSSATTGCLVPGPGPCDGNPCANGGSCSETPGSFECTCPRGFYGLRCE VSGVTCADGPCFNGGLCVGGADPDSAYICHCPPGFQGSNCEKRVDRCSLQPCRNGGLCLDLG HALRCRCRAGFAGPRCEHNLDDCAGRACANGGTCVEGGGAHRCSCALGFGGRDCRERADPCA ARPCAHGGRCYAHFSGLVCACAPGYMGSRCEFPVHPDGVSALPAAPPGLRPGDPQRYLSGGG GSGAGVIAIVVVVIAIVAGIVVLVISRKKRMAKYEKAEIKEMGEMHRELNA |
| 283 | — | Human DLL1 | human | MGSRCALALAVLSALLCQVWSSGVFELKLQEFVNKKGLLGNRNCCRGGAGPPPCACRTFFRV CLKHYQASVSPEPPCTYGSAVTPVLGVDSFSLPDGGGADSAFSNPIRFPFGFTWPGTFSLII EALHTDSPDDLATENPERLISRLATQRHLTVGEEWSQDLHSSGRTDLKYSYRFVCDEHYYGE GCSVFCRPRDDAFGHFTCGERGEKVCNPGWKGPYCTEPICLPGCDEQHGFCDKPGECKCRVG WQGRYCDECIRYPGCLHGTCQQPWQCNCQEGWGGLFCNQDLNYCTHHKPCKNGATCTNTGQG SYTCSCRPGYTGATCELGIDECDPSPCKNGGSCTDLENSYSCTCPPGFYGKICELSAMTCAD GPCFNGGRCSDSPDGGYSCRCPVGYSGFNCEKKIDYCSSSPCSNGAKCVDLGDAYLCRCQAG FSGRHCDDNVDDCASSPCANGGTCRDGVNDFSCTCPPGYTGRNCSAPVSRCEHAPCHNGATC HERGHRYVCECARGYGGPNCQFLLPELPPGPAVVDLTEKLEGQGGPFPWVAVCAGVILVLML LLGCAAVVVCVRLRLQKHRPPADPCRGETETMNNLANCQREKDISVSIIGATQIKNTNKKAD FHGDHSADKNGFKARYPAVDYNLVQDLKGDDTAVRDAHSKRDTKCQPQGSSGEEKGTPTTLR GGEASERKRPDSGCSTSKDTKYQSVYVISEEKDECVIATEV |
| 284 | — | Human DLL4 | human | MAAASRSASGWALLLLVALWQQRAAGSGVFQLQLQEFINERGVLASGRPCEPGCRTFFRVCL KHFQAVVSPGPCTFGTVSTPVLGTNSFAVRDDSSGGGRNPLQLPFNFTWPGTFSLIIEAWHA PGDDLRPEALPPDALISKIAIQGSLAVGQNWLLDEQTSTLTRLRYSYRVICSDNYYGDNCSR LCKKRNDHFGHYVCQPDGNLSCLPGWTGEYCQQPICLSGCHEQNGYCSKPAECLCRPGWQGR LCNECIPHNGCRHGTCSTPWQCTCDEGWGGLFCDQDLNYCTHHSPCKNGATCSNSGQRSYTC TCRPGYTGVDCELELSECDSNPCRNGGSCKDQEDGYHCLCPPGYYGLHCEHSTLSCADSPCF NGGSCRERNQGANYACECRPGYTGSNCEKKVDRCTSNPCANGGSCLNRGPSRMCRCRPGFTG TYCELHVSDCARNPCAHGGTCHDLENGLMCTCPAGFSGRRCEVRTSIDACASSPCFNRATCY TDLSTDTFVCNCPYGFVGSRCEFPVGLPPSFPWVAVSLGVGLAVLLVLLGMVAVAVRQLRLR RPDDGSREAMNNLSDFQKDNLIPAAQLKNTNQKKELEVDCGLDKSNCGKQQNHTLDYNLAPG PLGRGTMPGKFPHSDKSLGEKAPLRLHSEKPECRISAICSPRDSMYQSVCLISEERNECVIA TEV |
| 285 | — | linker 1 | artificial | GGGG |
| 286 | — | linker 2 | artificial | GGGGS |
| 287 | — | linker 3 | artificial | GGGGQ |
| 288 | — | linker 4 | artificial | SGGGGS |

TABLE 18-continued

| SEQ ID NO | DLL3-epitope | Designation | Format / Source | Amino acid sequence |
|---|---|---|---|---|
| 289 | — | linker 5 | artificial | PGGGGS |
| 290 | — | linker 6 | artificial | PGGDGS |
| 291 | — | linker 7 | artificial | GGGSGGGS |
| 292 | — | linker 8 | artificial | GGGGSGGGGS |
| 293 | — | linker 9 | artificial | GGGGSGGGGSGGGGS |
| 294 | — | Hexa-his | artificial | HHHHHH |
| 295 | — | Ab156 | artificial | RDWDFDVFGGGTPVGG |
| 296 | — | linear FcRn BP | artificial | QRFVTGHFGGLXPANG |
| 297 | — | linear FcRn BP-Y | artificial | QRFVTGHFGGLYPANG |
| 298 | — | linear FcRn BP-H | artificial | QRFVTGHFGGLHPANG |
| 299 | | core FcRn BP-H | artificial | TGHFGGLHP |
| 300 | | cyclic FcRn BP-H | artificial | QRFCTGHFGGLHPCNG |
| 301 | — | HALB | human | DAHKSEVAHRFKDLGEENFKALVLIAFAQYLQQCPFEDHVKLVNEVTEFAKTCVADESAENC DKSLHTLFGDKLCTVATLRETYGEMADCCAKQEPERNECFLQHKDDNPNLPRLVRPEVDVMC TAFHDNEETFLKKYLYEIARRHPYFYAPELLFFAKRYKAAFTECCQAADKAACLLPKLDELR DEGKASSAKQRLKCASLQKFGERAFKAWAVARLSQRFPKAEFAEVSKLVTDLTKVHTECCHG DLLECADDRADLAKYICENQDSISSKLKECCEKPLLEKSHCIAEVENDEMPADLPSLAADFV ESKDVCKNYAEAKDVFLGMFLYEYARRHPDYSVVLLLRLAKTYETTLEKCCAAADPHECYAK VFDEFKPLVEEPQNLIKQNCELFEQLGEYKFQNALLVRYTKKVPQVSTPTLVEVSRNLGKVG SKCCKHPEAKRMPCAEDYLSVVLNQLCVLHEKTPVSDRVTKCCTESLVNRRPCFSALEVDET YVPKEFNAETFTFHADICTLSEKERQIKKQTALVELVKHKPKATKEQLKAVMDDFAAFVEKC CKADDKETCFAEEGKKLVAASQAALGL |
| 302 | — | HALB variant 1 | artificial | DAHKSEVAHRFKDLGEENFKALVLIAFAQYLQQCPFEDHVKLVNEVTEFAKTCVADESAENC DKSLHTLFGDKLCTVATLRETYGEMADCCAKQEPERNECFLQHKDDNPNLPRLVRPEVDVMC TAFHDNEETFLKKYLYEIARRHPYFYAPELLFFAKRYKAAFTECCQAADKAACLLPKLDELR DEGKASSAKQRLKCASLQKFGERAFKAWAVARLSQRFPKAEFAEVSKLVTDLTKVHTECCHG DLLECADDRADLAKYICENQDSISSKLKECCEKPLLEKSHCIAEVENDEMPADLPSLAADFV ESKDVCKNYAEAKDVFLGMFLYEYARRHPDYSVVLLLRLAKTYETTLEKCCAAADPHECYAK VFDEFKPLVEEPQNLIKQNCELFEQLGEYKFQNALLVRYTKKVPQVSTPTLVEVSRNLGKVG SKCCKHPEAKRMPCAEDYLSVVLNQLCVLHEKTPVSDRVTKCCTESLVNRRPCFSALEVDET YVPKEFNAGTFTFHADICTLSEKERQIKKQTALVELVKHKPKATKEQLKAAMDDFAAFVEKC CKADDKETCFAEEGKKLVAASQAALGL |
| 303 | — | HALB variant 2 | artificial | DAHKSEVAHRFKDLGEENFKALVLIAFAQYLQQCPFEDHVKLVNEVTEFAKTCVADESAENC DKSLHTLFGDKLCTVATLRETYGEMADCCAKQEPERNECFLQHKDDNPNLPRLVRPEVDVMC TAFHDNEETFLKKYLYEIARRHPYFYAPELLFFAKRYKAAFTECCQAADKAACLLPKLDELR DEGKASSAKQRLKCASLQKFGERAFKAWAVARLSQRFPKAEFAEVSKLVTDLTKVHTECCHG DLLECADDRADLAKYICENQDSISSKLKECCEKPLLEKSHCIAEVENDEMPADLPSLAADFV ESKDVCKNYAEAKDVFLGMFLYEYARRHPDYSVVLLLRLAKTYETTLEKCCAAADPHECYAK VFDEFKPLVEEPQNLIKQNCELFEQLGEYKFQNALLVRYTKKVPQVSTPTLVEVSRNLGKVG SKCCKHPEAKRMPCAEDYLSVVLNQLCVLHEKTPVSDRVTKCCTESLVNRRPCFSALEVDET YVPKEFNAETFTFHADICTLSEKERQIKKQTALVELVKHKPKATKEQLKAVMDDFAAFVEKC CKADDKETCFAEEGPKLVAASQAALGL |
| 304 | — | HALB variant 3 | artificial | DAHKSEVAHRFKDLGEENFKALVLIAFAQYLQQCPFEDHVKLVNEVTEFAKTCVADESAENC DKSLHTLFGDKLCTVATLRETYGEMADCCAKQEPERNECFLQHKDDNPNLPRLVRPEVDVMC TAFHDNEETFLKKYLYEIARRHPYFYAPELLFFAKRYKAAFTECCQAADKAACLLPKLDELR DEGKASSAKQRLKCASLQKFGERAFKAWAVARLSQRFPKAEFAEVSKLVTDLTKVHTECCHG DLLECADDRADLAKYICENQDSISSKLKECCEKPLLEKSHCIAEVENDEMPADLPSLAADFV ESKDVCKNYAEAKDVFLGMFLYEYARRHPDYSVVLLLRLAKTYETTLEKCCAAADPHECYAK VFDEFKPLVEEPQNLIKQNCELFEQLGEYKFQNALLVRYTKKVPQVSTPTLVEVSRNLGKVG SKCCKHPEAKRMPCAEDYLSVVLNQLCVLHEKTPVSDRVTKCCTESLVNRRPCFSALDVDET YVPKEFNAETFTFHADICTLSEKERQIKKQTALVELVKHKPKATKEQLKAVMDDFAAFVEKC CKADDKETCFAEEGPHLVAASKAALGL |

TABLE 18-continued

| SEQ ID NO | DLL3-epitope | Designation | Format / Source | Amino acid sequence |
|---|---|---|---|---|
| 305 | — | HALB variant 4 | artificial | DAHKSEVAHRFKDLGEENFKALVLIAFAQYLQQCPFEDHVKLVNEVTEFAKTCVADESAENC DKSLHTLFGDKLCTVATLRETYGEMADCCAKQEPERNECFLQHKDDNPNLPRLVRPEVDVMC TAFHDNEETFLKKYLYEIARRHPYFYAPELLFFAKRYKAAFTECCQAADKAACLLPKLDELR DEGKASSAKQRLKCASLQKFGERAFKAWAVARLSQRFPKAEFAEVSKLVTDLTKVHTECCHG DLLECADDRADLAKYICENQDSISSKLKECCEKPLLEKSHCIAEVENDEMPADLPSLAADFV ESKDVCKNYAEAKDVFLGMFLYEYARRHPDYSVVLLLRLAKTYETTLEKCCAAADPHECYAK VFDEFKPLVEEPQNLIKQNCELFEQLGEYKFQNALLVRYTKKVPQVSTPTLVEVSRNLGKVG SKCCKHPEAKRMPCAEDYLSVVLNQLCVLHEKTPVSDRVTKCCTESLVNRRPCFSALGVDET YVPKEFNAETFTFHADICTLSEKERQIKKQTALVELVKHKPKATKEQLKAVMDKFAAFVEKC CKADDKETCFAEEGPKLVAASQAALGL |
| 306 | — | HALB variant 5 | artificial | DAHKSEVAHRFKDLGEENFKALVLIAFAQYLQQCPFEDHVKLVNEVTEFAKTCVADESAENC DKSLHTLFGDKLCTVATLRETYGEMADCCAKQEPERNECFLQHKDDNPNLPRLVRPEVDVMC TAFHDNEETFLKKYLYEIARRHPYFYAPELLFFAKRYKAAFTECCQAADKAACLLPKLDELR DEGKASSAKQRLKCASLQKFGERAFKAWAVARLSQRFPKAEFAEVSKLVTDLTKVHTECCHG DLLECADDRADLAKYICENQDSISSKLKECCEKPLLEKSHCIAEVENDEMPADLPSLAADFV ESKDVCKNYAEAKDVFLGMFLYEYARRHPDYSVVLLLRLAKTYETTLEKCCAAADPHECYAK VFDEFKPLVEEPQNLIKQNCELFEQLGEYKFQNALLVRYTKKVPQVSTPTLVEVSRNLGKVG SKCCKHPEAKRMPCAEDYLSVVLNQLCVLHEKTPVSDRVTKCCTESLVNRRPCFSALDVDET YVPKEFNAETFTFHADICTLSEKERQIKKQTALVELVKHKPKATKEQLKAVMDKFAAFVEKC CKADDKETCFAEEGPKLVAASQAALGL |
| 307 | — | HALB variant 6 | artificial | DAHKSEVAHRFKDLGEENFKALVLIAFAQYLQQCPFEDHVKLVNEVTEFAKTCVADESAENC DKSLHTLFGDKLCTVATLRETYGEMADCCAKQEPERNECFLQHKDDNPNLPRLVRPEVDVMC TAFHDNEETFLKKYLYEIARRHPYFYAPELLFFAKRYKAAFTECCQAADKAACLLPKLDELR DEGKASSAKQRLKCASLQKFGERAFKAWAVARLSQRFPKAEFAEVSKLVTDLTKVHTECCHG DLLECADDRADLAKYICENQDSISSKLKECCEKPLLEKSHCIAEVENDEMPADLPSLAADFV ESKDVCKNYAEAKDVFLGMFLYEYARRHPDYSVVLLLRLAKTYETTLEKCCAAADPHECYAK VFDEFKPLVEEPQNLIKQNCELFEQLGEYKFQNALLVRYTKKVPQVSTPTLVEVSRNLGKVG SKCCKHPEAKRMPCAEDYLSVVLNQLCVLHEKTPVSDRVTKCCTESLVNRRPCFSALEVDET YVPKEFNAETFTFHADICTLSEKERQIKKQTALVELVKHKPKATKEQLKAVMDKFAAFVEKC CKADDKETCFAEEGPHLVAASQAALGL |
| 308 | — | HALB variant 7 | artificial | DAHKSEVAHRFKDLGEENFKALVLIAFAQYLQQCPFEDHVKLVNEVTEFAKTCVADESAENC DKSLHTLFGDKLCTVATLRETYGEMADCCAKQEPERNECFLQHKDDNPNLPRLVRPEVDVMC TAFHDNEETFLKKYLYEIARRHPYFYAPELLFFAKRYKAAFTECCQAADKAACLLPKLDELR DEGKASSAKQRLKCASLQKFGERAFKAWAVARLSQRFPKAEFAEVSKLVTDLTKVHTECCHG DLLECADDRADLAKYICENQDSISSKLKECCEKPLLEKSHCIAEVENDEMPADLPSLAADFV ESKDVCKNYAEAKDVFLGMFLYEYARRHPDYSVVLLLRLAKTYETTLEKCCAAADPHECYAK VFDEFKPLVEEPQNLIKQNCELFEQLGEYKFQNALLVRYTKKVPQVSTPTLVEVSRNLGKVG SKCCKHPEAKRMPCAEDYLSVVLNQLCVLHEKTPVSDRVTKCCTESLVNRRPCFSALEVDET YVPKEFNAETFTFHADICTLSEKERQIKKQTALVELVKHKPKATKEQLKAVMDDFAAFVEKC CKADDKETCFAEEGPHLVAASKAALGL |
| 309 | — | HALB variant 8 | artificial | DAHKSEVAHRFKDLGEENFKALVLIAFAQYLQQCPFEDHVKLVNEVTEFAKTCVADESAENC DKSLHTLFGDKLCTVATLRETYGEMADCCAKQEPERNECFLQHKDDNPNLPRLVRPEVDVMC TAFHDNEETFLKKYLYEIARRHPYFYAPELLFFAKRYKAAFTECCQAADKAACLLPKLDELR DEGKASSAKQRLKCASLQKFGERAFKAWAVARLSQRFPKAEFAEVSKLVTDLTKVHTECCHG DLLECADDRADLAKYICENQDSISSKLKECCEKPLLEKSHCIAEVENDEMPADLPSLAADFV ESKDVCKNYAEAKDVFLGMFLYEYARRHPDYSVVLLLRLAKTYETTLEKCCAAADPHECYAK VFDEFKPLVEEPQNLIKQNCELFEQLGEYKFQNALLVRYTKKVPQVSTPTLVEVSRNLGKVG SKCCKHPEAKRMPCAEDYLSVVLNQLCVLHEKTPVSDRVTKCCTESLVNRRPCFSALEVDET YVPKEFNAETFTFHADICTLSEKERQIKKQTALVELVKHKPKATKEQLKAVMDKFAAFVEKC CKADDKETCFAEEGPKLVAASKAALGL |
| 310 | — | HALB variant 9 | artificial | DAHKSEVAHRFKDLGEENFKALVLIAFAQYLQQCPFEDHVKLVNEVTEFAKTCVADESAENC DKSLHTLFGDKLCTVATLRETYGEMADCCAKQEPERNECFLQHKDDNPNLPRLVRPEVDVMC TAFHDNEETFLKKYLYEIARRHPYFYAPELLFFAKRYKAAFTECCQAADKAACLLPKLDELR DEGKASSAKQRLKCASLQKFGERAFKAWAVARLSQRFPKAEFAEVSKLVTDLTKVHTECCHG DLLECADDRADLAKYICENQDSISSKLKECCEKPLLEKSHCIAEVENDEMPADLPSLAADFV ESKDVCKNYAEAKDVFLGMFLYEYARRHPDYSVVLLLRLAKTYETTLEKCCAAADPHECYAK VFDEFKPLVEEPQNLIKQNCELFEQLGEYKFQNALLVRYTKKVPQVSTPTLVEVSRNLGKVG SKCCKHPEAKRMPCAEDYLSVVLNQLCVLHEKTPVSDRVTKCCTESLVNRRPCFSALDVDET YVPKEFNAETFTFHADICTLSEKERQIKKQTALVELVKHKPKATKEQLKAVMDDFAAFVEKC CKADDKETCFAEEGPKLVAASKAALGL |
| 311 | — | HALB variant 10 | artificial | DAHKSEVAHRFKDLGEENFKALVLIAFAQYLQQSPFEDHVKLVNEVTEFAKTCVADESAENC DKSLHTLFGDKLCTVATLRETYGEMADCCAKQEPERNECFLQHKDDNPNLPRLVRPEVDVMC TAFHDNEETFLKKYLYEIARRHPYFYAPELLFFAKRYKAAFTECCQAADKAACLLPKLDELR DEGKASSAKQRLKCASLQKFGERAFKAWAVARLSQRFPKAEFAEVSKLVTDLTKVHTECCHG DLLECADDRADLAKYICENQDSISSKLKECCEKPLLEKSHCIAEVENDEMPADLPSLAADFV ESKDVCKNYAEAKDVFLGMFLYEYARRHPDYSVVLLLRLAKTYETTLEKCCAAADPHECYAK VFDEFKPLVEEPQNLIKQNCELFEQLGEYKFQNALLVRYTKKVPQVSTPTLVEVSRNLGKVG SKCCKHPEAKRMPCAEDYLSVVLNQLCVLHEKTPVSDRVTKCCTESLVNRRPCFSALEVDET YVPKEFNAETFTFHADICTLSEKERQIKKQTALVELVKHKPKATKEQLKAVMDDFAAFVEKC CKADDKETCFAEEGKKLVAASQAALGL |

TABLE 18-continued

| SEQ ID NO | DLL3-epitope | Designation | Format / Source | Amino acid sequence |
|---|---|---|---|---|
| 312 | — | HALB variant 11 | artificial | DAHKSEVAHRFKDLGEENFKALVLIAFAQYLQQSPFEDHVKLVNEVTEFAKTCVADESAENC DKSLHTLFGDKLCTVATLRETYGEMADCCAKQEPERNECFLQHKDDNPNLPRLVRPEVDVMC TAFHDNEETFLKKYLYEIARRHPYFYAPELLFFAKRYKAAFTECCQAADKAACLLPKLDELR DEGKASSAKQRLKCASLQKFGERAFKAWAVARLSQRFPKAEFAEVSKLVTDLTKVHTECCHG DLLECADDRADLAKYICENQDSISSKLKECCEKPLLEKSHCIAEVENDEMPADLPSLAADFV ESKDVCKNYAEAKDVFLGMFLYEYARRHPDYSVVLLLRLAKTYETTLEKCCAAADPHECYAK VFDEFKPLVEEPQNLIKQNCELFEQLGEYKFQNALLVRYTKKVPQVSTPTLVEVSRNLGKVG SKCCCKHPEAKRMPCAEDYLSVVLNQLCVLHEKTPVSDRVTKCCTESLVNRRPCFSALEVDET YVPKEFNAGTFTFHADICTLSEKERQIKKQTALVELVKHKPKATKEQLKAAMDDFAAFVEKC CKADDKETCFAEEGKKLVAASQAALGL |
| 313 | — | HALB variant 12 | artificial | DAHKSEVAHRFKDLGEENFKALVLIAFAQYLQQSPFEDHVKLVNEVTEFAKTCVADESAENC DKSLHTLFGDKLCTVATLRETYGEMADCCAKQEPERNECFLQHKDDNPNLPRLVRPEVDVMC TAFHDNEETFLKKYLYEIARRHPYFYAPELLFFAKRYKAAFTECCQAADKAACLLPKLDELR DEGKASSAKQRLKCASLQKFGERAFKAWAVARLSQRFPKAEFAEVSKLVTDLTKVHTECCHG DLLECADDRADLAKYICENQDSISSKLKECCEKPLLEKSHCIAEVENDEMPADLPSLAADFV ESKDVCKNYAEAKDVFLGMFLYEYARRHPDYSVVLLRLAKTYETTLEKCCAAADPHECYAK VFDEFKPLVEEPQNLIKQNCELFEQLGEYKFQNALLVRYTKKVPQVSTPTLVEVSRNLGKVG SKCCCKHPEAKRMPCAEDYLSVVLNQLCVLHEKTPVSDRVTKCCTESLVNRRPCFSALEVDET YVPKEFNAETFTFHADICTLSEKERQIKKQTALVELVKHKPKATKEQLKAVMDDFAAFVEKC CKADDKETCFAEEGPKLVAASQAALGL |
| 314 | — | HALB variant 13 | artificial | DAHKSEVAHRFKDLGEENFKALVLIAFAQYLQQSPFEDHVKLVNEVTEFAKTCVADESAENC DKSLHTLFGDKLCTVATLRETYGEMADCCAKQEPERNECFLQHKDDNPNLPRLVRPEVDVMC TAFHDNEETFLKKYLYEIARRHPYFYAPELLFFAKRYKAAFTECCQAADKAACLLPKLDELR DEGKASSAKQRLKCASLQKFGERAFKAWAVARLSQRFPKAEFAEVSKLVTDLTKVHTECCHG DLLECADDRADLAKYICENQDSISSKLKECCEKPLLEKSHCIAEVENDEMPADLPSLAADFV ESKDVCKNYAEAKDVFLGMFLYEYARRHPDYSVVLLRLAKTYETTLEKCCAAADPHECYAK VFDEFKPLVEEPQNLIKQNCELFEQLGEYKFQNALLVRYTKKVPQVSTPTLVEVSRNLGKVG SKCCCKHPEAKRMPCAEDYLSVVLNQLCVLHEKTPVSDRVTKCCTESLVNRRPCFSALDVDET YVPKEFNAETFTFHADICTLSEKERQIKKQTALVELVKHKPKATKEQLKAVMDDFAAFVEKC CKADDKETCFAEEGPHLVAASKAALGL |
| 315 | — | HALB variant 14 | artificial | DAHKSEVAHRFKDLGEENFKALVLIAFAQYLQQSPFEDHVKLVNEVTEFAKTCVADESAENC DKSLHTLFGDKLCTVATLRETYGEMADCCAKQEPERNECFLQHKDDNPNLPRLVRPEVDVMC TAFHDNEETFLKKYLYEIARRHPYFYAPELLFFAKRYKAAFTECCQAADKAACLLPKLDELR DEGKASSAKQRLKCASLQKFGERAFKAWAVARLSQRFPKAEFAEVSKLVTDLTKVHTECCHG DLLECADDRADLAKYICENQDSISSKLKECCEKPLLEKSHCIAEVENDEMPADLPSLAADFV ESKDVCKNYAEAKDVFLGMFLYEYARRHPDYSVVLLRLAKTYETTLEKCCAAADPHECYAK VFDEFKPLVEEPQNLIKQNCELFEQLGEYKFQNALLVRYTKKVPQVSTPTLVEVSRNLGKVG SKCCCKHPEAKRMPCAEDYLSVVLNQLCVLHEKTPVSDRVTKCCTESLVNRRPCFSALGVDET YVPKEFNAETFTFHADICTLSEKERQIKKQTALVELVKHKPKATKEQLKAVMDKFAAFVEKC CKADDKETCFAEEGPKLVAASQAALGL |
| 316 | — | HALB variant 15 | artificial | DAHKSEVAHRFKDLGEENFKALVLIAFAQYLQQSPFEDHVKLVNEVTEFAKTCVADESAENC DKSLHTLFGDKLCTVATLRETYGEMADCCAKQEPERNECFLQHKDDNPNLPRLVRPEVDVMC TAFHDNEETFLKKYLYEIARRHPYFYAPELLFFAKRYKAAFTECCQAADKAACLLPKLDELR DEGKASSAKQRLKCASLQKFGERAFKAWAVARLSQRFPKAEFAEVSKLVTDLTKVHTECCHG DLLECADDRADLAKYICENQDSISSKLKECCEKPLLEKSHCIAEVENDEMPADLPSLAADFV ESKDVCKNYAEAKDVFLGMFLYEYARRHPDYSVVLLRLAKTYETTLEKCCAAADPHECYAK VFDEFKPLVEEPQNLIKQNCELFEQLGEYKFQNALLVRYTKKVPQVSTPTLVEVSRNLGKVG SKCCCKHPEAKRMPCAEDYLSVVLNQLCVLHEKTPVSDRVTKCCTESLVNRRPCFSALDVDET YVPKEFNAETFTFHADICTLSEKERQIKKQTALVELVKHKPKATKEQLKAVMDKFAAFVEKC CKADDKETCFAEEGPKLVAASQAALGL |
| 317 | — | HALB variant 16 | artificial | DAHKSEVAHRFKDLGEENFKALVLIAFAQYLQQSPFEDHVKLVNEVTEFAKTCVADESAENC DKSLHTLFGDKLCTVATLRETYGEMADCCAKQEPERNECFLQHKDDNPNLPRLVRPEVDVMC TAFHDNEETFLKKYLYEIARRHPYFYAPELLFFAKRYKAAFTECCQAADKAACLLPKLDELR DEGKASSAKQRLKCASLQKFGERAFKAWAVARLSQRFPKAEFAEVSKLVTDLTKVHTECCHG DLLECADDRADLAKYICENQDSISSKLKECCEKPLLEKSHCIAEVENDEMPADLPSLAADFV ESKDVCKNYAEAKDVFLGMFLYEYARRHPDYSVVLLRLAKTYETTLEKCCAAADPHECYAK VFDEFKPLVEEPQNLIKQNCELFEQLGEYKFQNALLVRYTKKVPQVSTPTLVEVSRNLGKVG SKCCCKHPEAKRMPCAEDYLSVVLNQLCVLHEKTPVSDRVTKCCTESLVNRRPCFSALEVDET YVPKEFNAETFTFHADICTLSEKERQIKKQTALVELVKHKPKATKEQLKAVMDKFAAFVEKC CKADDKETCFAEEGPHLVAASQAALGL |
| 318 | — | HALB variant 17 | artificial | DAHKSEVAHRFKDLGEENFKALVLIAFAQYLQQSPFEDHVKLVNEVTEFAKTCVADESAENC DKSLHTLFGDKLCTVATLRETYGEMADCCAKQEPERNECFLQHKDDNPNLPRLVRPEVDVMC TAFHDNEETFLKKYLYEIARRHPYFYAPELLFFAKRYKAAFTECCQAADKAACLLPKLDELR DEGKASSAKQRLKCASLQKFGERAFKAWAVARLSQRFPKAEFAEVSKLVTDLTKVHTECCHG DLLECADDRADLAKYICENQDSISSKLKECCEKPLLEKSHCIAEVENDEMPADLPSLAADFV ESKDVCKNYAEAKDVFLGMFLYEYARRHPDYSVVLLRLAKTYETTLEKCCAAADPHECYAK VFDEFKPLVEEPQNLIKQNCELFEQLGEYKFQNALLVRYTKKVPQVSTPTLVEVSRNLGKVG |

TABLE 18-continued

| SEQ ID NO | DLL3-epitope | Designation | Format / Source | Amino acid sequence |
|---|---|---|---|---|
| | | | | SKCCKHPEAKRMPCAEDYLSVVLNQLCVLHEKTPVSDRVTKCCTESLVNRRPCFSALEVDET YVPKEFNAETFTFHADICTLSEKERQIKKQTALVELVKHKPKATKEQLKAVMDDFAAFVEKC CKADDKETCFAEEGPHLVAASKAALGL |
| 319 | — | HALB variant 18 | artificial | DAHKSEVAHRFKDLGEENFKALVLIAFAQYLQQSPFEDHVKLVNEVTEFAKTCVADESAENC DKSLHTLFGDKLCTVATLRETYGEMADCCAKQEPERNECFLQHKDDNPNLPRLVRPEVDVMC TAPHDNEETFLKKYLYEIARRHPYFYAPELLFFAKRYKAAFTECCQAADKAACLLPKLDELR DEGKASSAKQRLKCASLQKFGERAFKAWAVARLSQRFPKAEFAEVSKLVTDLTKVHTECCHG DLLECADDRADLAKYICENQDSISSKLKECCEKPLLEKSHCIAEVENDEMPADLPSLAADFV ESKDVCKNYAEAKDVFLGMFLYEYARRHPDYSVVLLLRLAKTYETTLEKCCAAADPHECYAK VFDEFKPLVEEPQNLIKQNCELFEQLGEYKFQNALLVRYTKKVPQVSTPTLVEVSRNLGKVG SKCCKHPEAKRMPCAEDYLSVVLNQLCVLHEKTPVSDRVTKCCTESLVNRRPCFSALEVDET YVPKEFNAETFTFHADICTLSEKERQIKKQTALVELVKHKPKATKEQLKAVMDKFAAFVEKC CKADDKETCFAEEGPKLVAASKAALGL |
| 320 | — | HALB variant 19 | artificial | DAHKSEVAHRFKDLGEENFKALVLIAFAQYLQQSPFEDHVKLVNEVTEFAKTCVADESAENC DKSLHTLFGDKLCTVATLRETYGEMADCCAKQEPERNECFLQHKDDNPNLPRLVRPEVDVMC TAPHDNEETFLKKYLYEIARRHPYFYAPELLFFAKRYKAAFTECCQAADKAACLLPKLDELR DEGKASSAKQRLKCASLQKFGERAFKAWAVARLSQRFPKAEFAEVSKLVTDLTKVHTECCHG DLLECADDRADLAKYICENQDSISSKLKECCEKPLLEKSHCIAEVENDEMPADLPSLAADFV ESKDVCKNYAEAKDVFLGMFLYEYARRHPDYSVVLLLRLAKTYETTLEKCCAAADPHECYAK VFDEFKPLVEEPQNLIKQNCELFEQLGEYKFQNALLVRYTKKVPQVSTPTLVEVSRNLGKVG SKCCKHPEAKRMPCAEDYLSVVLNQLCVLHEKTPVSDRVTKCCTESLVNRRPCFSALDVDET YVPKEFNAETFTFHADICTLSEKERQIKKQTALVELVKHKPKATKEQLKAVMDDFAAFVEKC CKADDKETCFAEEGPKLVAASKAALGL |
| 321 | — | HALB variant 20 | artificial | DAHKSEVAHRFKDLGEENFKALVLIAFAQYLQQAPFEDHVKLVNEVTEFAKTCVADESAENC DKSLHTLFGDKLCTVATLRETYGEMADCCAKQEPERNECFLQHKDDNPNLPRLVRPEVDVMC TAPHDNEETFLKKYLYEIARRHPYFYAPELLFFAKRYKAAFTECCQAADKAACLLPKLDELR DEGKASSAKQRLKCASLQKFGERAFKAWAVARLSQRFPKAEFAEVSKLVTDLTKVHTECCHG DLLECADDRADLAKYICENQDSISSKLKECCEKPLLEKSHCIAEVENDEMPADLPSLAADFV ESKDVCKNYAEAKDVFLGMFLYEYARRHPDYSVVLLLRLAKTYETTLEKCCAAADPHECYAK VFDEFKPLVEEPQNLIKQNCELFEQLGEYKFQNALLVRYTKKVPQVSTPTLVEVSRNLGKVG SKCCKHPEAKRMPCAEDYLSVVLNQLCVLHEKTPVSDRVTKCCTESLVNRRPCFSALEVDET YVPKEFNAETFTFHADICTLSEKERQIKKQTALVELVKHKPKATKEQLKAVMDDFAAFVEKC CKADDKETCFAEEGKKLVAASQAALGL |
| 322 | — | HALB variant 21 | artificial | DAHKSEVAHRFKDLGEENFKALVLIAFAQYLQQAPFEDHVKLVNEVTEFAKTCVADESAENC DKSLHTLFGDKLCTVATLRETYGEMADCCAKQEPERNECFLQHKDDNPNLPRLVRPEVDVMC TAPHDNEETFLKKYLYEIARRHPYFYAPELLFFAKRYKAAFTECCQAADKAACLLPKLDELR DEGKASSAKQRLKCASLQKFGERAFKAWAVARLSQRFPKAEFAEVSKLVTDLTKVHTECCHG DLLECADDRADLAKYICENQDSISSKLKECCEKPLLEKSHCIAEVENDEMPADLPSLAADFV ESKDVCKNYAEAKDVFLGMFLYEYARRHPDYSVVLLLRLAKTYETTLEKCCAAADPHECYAK VFDEFKPLVEEPQNLIKQNCELFEQLGEYKFQNALLVRYTKKVPQVSTPTLVEVSRNLGKVG SKCCKHPEAKRMPCAEDYLSVVLNQLCVLHEKTPVSDRVTKCCTESLVNRRPCFSALEVDET YVPKEFNAGTFTFHADICTLSEKERQIKKQTALVELVKHKPKATKEQLKAAMDDFAAFVEKC CKADDKETCFAEEGKKLVAASQAALGL |
| 323 | — | HALB variant 22 | artificial | DAHKSEVAHRFKDLGEENFKALVLIAFAQYLQQAPFEDHVKLVNEVTEFAKTCVADESAENC DKSLHTLFGDKLCTVATLRETYGEMADCCAKQEPERNECFLQHKDDNPNLPRLVRPEVDVMC TAPHDNEETFLKKYLYEIARRHPYFYAPELLFFAKRYKAAFTECCQAADKAACLLPKLDELR DEGKASSAKQRLKCASLQKFGERAFKAWAVARLSQRFPKAEFAEVSKLVTDLTKVHTECCHG DLLECADDRADLAKYICENQDSISSKLKECCEKPLLEKSHCIAEVENDEMPADLPSLAADFV ESKDVCKNYAEAKDVFLGMFLYEYARRHPDYSVVLLLRLAKTYETTLEKCCAAADPHECYAK VFDEFKPLVEEPQNLIKQNCELFEQLGEYKFQNALLVRYTKKVPQVSTPTLVEVSRNLGKVG SKCCKHPEAKRMPCAEDYLSVVLNQLCVLHEKTPVSDRVTKCCTESLVNRRPCFSALEVDET YVPKEFNAETFTFHADICTLSEKERQIKKQTALVELVKHKPKATKEQLKAVMDDFAAFVEKC CKADDKETCFAEEGPKLVAASQAALGL |
| 324 | — | HALB variant 23 | artificial | DAHKSEVAHRFKDLGEENFKALVLIAFAQYLQQAPFEDHVKLVNEVTEFAKTCVADESAENC DKSLHTLFGDKLCTVATLRETYGEMADCCAKQEPERNECFLQHKDDNPNLPRLVRPEVDVMC TAPHDNEETFLKKYLYEIARRHPYFYAPELLFFAKRYKAAFTECCQAADKAACLLPKLDELR DEGKASSAKQRLKCASLQKFGERAFKAWAVARLSQRFPKAEFAEVSKLVTDLTKVHTECCHG DLLECADDRADLAKYICENQDSISSKLKECCEKPLLEKSHCIAEVENDEMPADLPSLAADFV ESKDVCKNYAEAKDVFLGMFLYEYARRHPDYSVVLLLRLAKTYETTLEKCCAAADPHECYAK VFDEFKPLVEEPQNLIKQNCELFEQLGEYKFQNALLVRYTKKVPQVSTPTLVEVSRNLGKVG SKCCKHPEAKRMPCAEDYLSVVLNQLCVLHEKTPVSDRVTKCCTESLVNRRPCFSALDVDET YVPKEFNAETFTFHADICTLSEKERQIKKQTALVELVKHKPKATKEQLKAVMDDFAAFVEKC CKADDKETCFAEEGPHLVAASKAALGL |
| 325 | — | HALB variant 24 | artificial | DAHKSEVAHRFKDLGEENFKALVLIAFAQYLQQAPFEDHVKLVNEVTEFAKTCVADESAENC DKSLHTLFGDKLCTVATLRETYGEMADCCAKQEPERNECFLQHKDDNPNLPRLVRPEVDVMC TAPHDNEETFLKKYLYEIARRHPYFYAPELLFFAKRYKAAFTECCQAADKAACLLPKLDELR DEGKASSAKQRLKCASLQKFGERAFKAWAVARLSQRFPKAEFAEVSKLVTDLTKVHTECCHG DLLECADDRADLAKYICENQDSISSKLKECCEKPLLEKSHCIAEVENDEMPADLPSLAADFV ESKDVCKNYAEAKDVFLGMFLYEYARRHPDYSVVLLLRLAKTYETTLEKCCAAADPHECYAK |

TABLE 18-continued

| SEQ ID NO | DLL3-epitope | Designation | Format / Source | Amino acid sequence |
|---|---|---|---|---|
| | | | | VFDEFKPLVEEPQNLIKQNCELFEQLGEYKFQNALLVRYTKKVPQVSTPTLVEVSRNLGKVG SKCCKHPEAKRMPCAEDYLSVVLNQLCVLHEKTPVSDRVTKCCTESLVNRRPCFSALGVDET YVPKEFNAETFTFHADICTLSEKERQIKKQTALVELVKHKPKATKEQLKAVMDKFAAFVEKC CKADDKETCFAEEGPKLVAASQAALGL |
| 326 | — | HALB variant 25 | artificial | DAHKSEVAHRFKDLGEENFKALVLIAFAQYLQQAPFEDHVKLVNEVTEFAKTCVADESAENC DKSLHTLFGDKLCTVATLRETYGEMADCCAKQEPERNECFLQHKDDNPNLPRLVRPEVDVMC TAFHDNEETFLKKYLYEIARRHPYFYAPELLFFAKRYKAAFTECCQAADKAACLLPKLDELR DEGKASSAKQRLKCASLQKFGERAFKAWAVARLSQRFPKAEFAEVSKLVTDLTKVHTECCHG DLLECADDRADLAKYICENQDSISSKLKECCEKPLLEKSHCIAEVENDEMPADLPSLAADFV ESKDVCKNYAEAKDVFLGMFLYEYARRHPDYSVVLLLRLAKTYETTLEKCCAAADPHECYAK VFDEFKPLVEEPQNLIKQNCELFEQLGEYKFQNALLVRYTKKVPQVSTPTLVEVSRNLGKVG SKCCKHPEAKRMPCAEDYLSVVLNQLCVLHEKTPVSDRVTKCCTESLVNRRPCFSALDVDET YVPKEFNAETFTFHADICTLSEKERQIKKQTALVELVKHKPKATKEQLKAVMDKFAAFVEKC CKADDKETCFAEEGPKLVAASQAALGL |
| 327 | — | HALB variant 26 | artificial | DAHKSEVAHRFKDLGEENFKALVLIAFAQYLQQAPFEDHVKLVNEVTEFAKTCVADESAENC DKSLHTLFGDKLCTVATLRETYGEMADCCAKQEPERNECFLQHKDDNPNLPRLVRPEVDVMC TAFHDNEETFLKKYLYEIARRHPYFYAPELLFFAKRYKAAFTECCQAADKAACLLPKLDELR DEGKASSAKQRLKCASLQKFGERAFKAWAVARLSQRFPKAEFAEVSKLVTDLTKVHTECCHG DLLECADDRADLAKYICENQDSISSKLKECCEKPLLEKSHCIAEVENDEMPADLPSLAADFV ESKDVCKNYAEAKDVFLGMFLYEYARRHPDYSVVLLLRLAKTYETTLEKCCAAADPHECYAK VFDEFKPLVEEPQNLIKQNCELFEQLGEYKFQNALLVRYTKKVPQVSTPTLVEVSRNLGKVG SKCCKHPEAKRMPCAEDYLSVVLNQLCVLHEKTPVSDRVTKCCTESLVNRRPCFSALEVDET YVPKEFNAETFTFHADICTLSEKERQIKKQTALVELVKHKPKATKEQLKAVMDKFAAFVEKC CKADDKETCFAEEGPHLVAASQAALGL |
| 328 | — | HALB variant 27 | artificial | DAHKSEVAHRFKDLGEENFKALVLIAFAQYLQQAPFEDHVKLVNEVTEFAKTCVADESAENC DKSLHTLFGDKLCTVATLRETYGEMADCCAKQEPERNECFLQHKDDNPNLPRLVRPEVDVMC TAFHDNEETFLKKYLYEIARRHPYFYAPELLFFAKRYKAAFTECCQAADKAACLLPKLDELR DEGKASSAKQRLKCASLQKFGERAFKAWAVARLSQRFPKAEFAEVSKLVTDLTKVHTECCHG DLLECADDRADLAKYICENQDSISSKLKECCEKPLLEKSHCIAEVENDEMPADLPSLAADFV ESKDVCKNYAEAKDVFLGMFLYEYARRHPDYSVVLLLRLAKTYETTLEKCCAAADPHECYAK VFDEFKPLVEEPQNLIKQNCELFEQLGEYKFQNALLVRYTKKVPQVSTPTLVEVSRNLGKVG SKCCKHPEAKRMPCAEDYLSVVLNQLCVLHEKTPVSDRVTKCCTESLVNRRPCFSALEVDET YVPKEFNAETFTFHADICTLSEKERQIKKQTALVELVKHKPKATKEQLKAVMDDFAAFVEKC CKADDKETCFAEEGPHLVAASKAALGL |
| 329 | — | HALB variant 28 | artificial | DAHKSEVAHRFKDLGEENFKALVLIAFAQYLQQAPFEDHVKLVNEVTEFAKTCVADESAENC DKSLHTLFGDKLCTVATLRETYGEMADCCAKQEPERNECFLQHKDDNPNLPRLVRPEVDVMC TAFHDNEETFLKKYLYEIARRHPYFYAPELLFFAKRYKAAFTECCQAADKAACLLPKLDELR DEGKASSAKQRLKCASLQKFGERAFKAWAVARLSQRFPKAEFAEVSKLVTDLTKVHTECCHG DLLECADDRADLAKYICENQDSISSKLKECCEKPLLEKSHCIAEVENDEMPADLPSLAADFV ESKDVCKNYAEAKDVFLGMFLYEYARRHPDYSVVLLLRLAKTYETTLEKCCAAADPHECYAK VFDEFKPLVEEPQNLIKQNCELFEQLGEYKFQNALLVRYTKKVPQVSTPTLVEVSRNLGKVG SKCCKHPEAKRMPCAEDYLSVVLNQLCVLHEKTPVSDRVTKCCTESLVNRRPCFSALEVDET YVPKEFNAETFTFHADICTLSEKERQIKKQTALVELVKHKPKATKEQLKAVMDKFAAFVEKC CKADDKETCFAEEGPKLVAASKAALGL |
| 330 | — | HALB variant 29 | artificial | DAHKSEVAHRFKDLGEENFKALVLIAFAQYLQQAPFEDHVKLVNEVTEFAKTCVADESAENC DKSLHTLFGDKLCTVATLRETYGEMADCCAKQEPERNECFLQHKDDNPNLPRLVRPEVDVMC TAFHDNEETFLKKYLYEIARRHPYFYAPELLFFAKRYKAAFTECCQAADKAACLLPKLDELR DEGKASSAKQRLKCASLQKFGERAFKAWAVARLSQRFPKAEFAEVSKLVTDLTKVHTECCHG DLLECADDRADLAKYICENQDSISSKLKECCEKPLLEKSHCIAEVENDEMPADLPSLAADFV ESKDVCKNYAEAKDVFLGMFLYEYARRHPDYSVVLLLRLAKTYETTLEKCCAAADPHECYAK VFDEFKPLVEEPQNLIKQNCELFEQLGEYKFQNALLVRYTKKVPQVSTPTLVEVSRNLGKVG SKCCKHPEAKRMPCAEDYLSVVLNQLCVLHEKTPVSDRVTKCCTESLVNRRPCFSALDVDET YVPKEFNAETFTFHADICTLSEKERQIKKQTALVELVKHKPKATKEQLKAVMDDFAAFVEKC CKADDKETCFAEEGPKLVAASKAALGL |
| 331 | — | Cross body 1 HC | artificial | ASTKGPSVFPLAPSSKSTSGGTAALGCLVKDYFPEPVTVSWNSGALTSGVHTFPAVLQSSGL YSLSSVVTVPSSSLGTQTYICNVNHKPSNTKVDKKVEPKSCDKTHTCPPCPAPELLGGPSVF LFPPKPKDTLMISRTPEVTCVVVDVSHEDPEVKFNWYVDGVEVHNAKTKPCEEQYGSTYRCV SVLTVLHQDWLNGKEYKCKVSNKALPAPIEKTISKAKGQPREPQVYTLPPSREEMTKNQVSL TCLVKGFYPSDIAVEWESNGQPENNYDTTPPVLDSDGSFFLYSDLTVDKSRWQQGNVFSCSV MHEALHNHYTQKSLSLSPGK |
| 332 | — | Cross body 1 LC | artificial | GQPKAAPSVTLFPPSSEELQANKATLVCLISDFYPGAVTVAWKADSSPVKAGVETTTPSKQS NNKYAASSYLSLTPEQWKSHRSYSCQVTHEGSTVEKTVAPTECSDKTHTCPPCPAPELLGGP SVFLFPPKPKDTLMISRTPEVTCVVVDVSHEDPEVKFNWYVDGVEVHNAKTKPCEEQYGSTY RCVSVLTVLHQDWLNGKEYKCKVSNKALPAPIEKTISKAKGQPREPQVYTLPPSRKEMTKNQ VSLTCLVKGFYPSDIAVEWESNGQPENNYKTTPPVLKSDGSFFLYSKLTVDKSRWQQGNVFS CSVMHEALHNHYTQKSLSLSPGK |

TABLE 18-continued

| SEQ ID NO | DLL3-epitope | Designation | Format / Source | Amino acid sequence |
|---|---|---|---|---|
| 333 | — | Cross body 2 HC | artificial | ASTKGPSVFPLAPCSRSTSESTAALGCLVKDYFPEPVTVSWNSGALTSGVHTFPAVLQSSGL YSLSSVVTVPSSNFGTQTYTCNVDHKPSNTKVDKTVEPKSSDKTHTCPPCPAPEAAGGPSVF LFPPKPKDTLMISRTPEVTCVVVDVSHEDPEVKFNWYVDGVEVHNAKTKPREEQYNSTYRVV SVLTVLHQDWLNGKEYKCKVSNKALPAPIEKTISKAKGQPREPQVYTLPPSREEMTKNQVSL TCLVKGFYPSDIAVEWESNGQPENNYDTTPPVLDSDGSFFLYSDLTVDKSRWQQGNVFSCSV MHEALHNHYTQKSLSLSPGK |
| 334 | — | Cross body 2 LC | artificial | GQPKAAPSVTLFPPSSEELQANKATLVCLISDFYPGAVTVAWKADSSPVKAGVETTTPSKQS NNKYAASSYLSLTPEQWKSHRSYSCQVTHEGSTVEKTVAPTECSEPKSSDKTHTCPPCPAPE AAGGPSVFLFPPKPKDTLMISRTPEVTCVVVDVSHEDPEVKFNWYVDGVEVHNAKTKPREEQ YNSTYRVVSVLTVLHQDWLNGKEYKCKVSNKALPAPIEKTISKAKGQPREPQVYTLPPSRKE MTKNQVSLTCLVKGFYPSDIAVEWESNGQPENNYKTTPPVLKDGSFFLYSKLTVDKSRWQQ GNVFSCSVMHEALHNHYTQKSLSLSPGK |
| 335 | — | Hetero-Fc binder Fc | artificial | DKTHTCPPCPAPELLGGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALPAPIEKTISKAKGQPR EPQVYTLPPSRKEMTKNQVSLTCLVKGFYPSDIAVEWESNGQPENNYKTTPPVLKSDGSFFL YSKLTVDKSRWQQGNVFSCSVMHEALHNHYTQKSLSLSPGK |
| 336 | — | Hetero-Fc partner Fc | artificial | DKTHTCPPCPAPELLGGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALPAPIEKTISKAKGQPR EPQVYTLPPSREEMTKNQVSLTCLVKGFYPSDIAVEWESNGQPENNYDTTPPVLDSDGSFFL YSDLTVDKSRWQQGNVFSCSVMHEALHNHYTQKSLSLSPGK |
| 337 | — | Maxibody 1 target Fc | artificial | EPKSSDKTHTCPPCPAPELLGGPSVFLFPPKPKDTLMISRTPEVTCVVVDVSHEDPEVKFNW YVDGVEVHNAKTKPCEEQYGSTYRCVSVLTVLHQDWLNGKEYKCKVSNKALPAPIEKTISKA KGQPREPQVYTLPPSRKEMTKNQVSLTCLVKGFYPSDIAVEWESNGQPENNYKTTPPVLKSD GSFFLYSKLTVDKSRWQQGNVFSCSVMHEALHNHYTQKSLSLSPGK |
| 338 | — | Maxibody 1 CD3 Fc | artificial | EPKSSDKTHTCPPCPAPELLGGPSVFLFPPKPKDTLMISRTPEVTCVVVDVSHEDPEVKFNW YVDGVEVHNAKTKPCEEQYGSTYRCVSVLTVLHQDWLNGKEYKCKVSNKALPAPIEKTISKA KGQPREPQVYTLPPSREEMTKNQVSLTCLVKGFYPSDIAVEWESNGQPENNYDTTPPVLDSD GSFFLYSDLTVDKSRWQQGNVFSCSVMHEALHNHYTQKSLSLSPGK |
| 339 | — | Maxibody 2 target Fc | artificial | EPKSSDKTHTCPPCPAPEAAGGPSVFLFPPKPKDTLMISRTPEVTCVVVDVSHEDPEVKFNW YVDGVEVHNAKTKPREEQYNSTYRVVSVLTVLHQDWLNGKEYKCKVSNKALPAPIEKTISKA KGQPREPQVYTLPPSRKEMTKNQVSLTCLVKGFYPSDIAVEWESNGQPENNYKTTPPVLKSD GSFFLYSKLTVDKSRWQQGNVFSCSVMHEALHNHYTQKSLSLSPGK |
| 340 | — | Maxibody 2 CD3 Fc | artificial | EPKSSDKTHTCPPCPAPEAAGGPSVFLFPPKPKDTLMISRTPEVTCVVVDVSHEDPEVKFNW YVDGVEVHNAKTKPREEQYNSTYRVVSVLTVLHQDWLNGKEYKCKVSNKALPAPIEKTISKA KGQPREPQVYTLPPSREEMTKNQVSLTCLVKGFYPSDIAVEWESNGQPENNYDTTPPVLDSD GSFFLYSDLTVDKSRWQQGNVFSCSVMHEALHNHYTQKSLSLSPGK |
| 341 | — | Mono Fc | artificial | APELLGGPSVFLFPPKPKDTLMISRTPEVTCVVVDVSHEDPEVKFNWYVDGVEVHNAKTKPR EEQYNSTYRVVSVLTVLHQDWLNGKEYKCKVSNKALPAPIEKTISKAKGQPREPQVTTLPPS REEMTKNQVSLTCLVKGFYPSDIAVEWESNGQPENNYDTTPPVLDSDGSFFLYSDLTVDKSR WQQGNVFSCSVMHEALHNHYTQKSLSLSPGK |
| 342 | — | CDR-L1 of F6A | artificial | GSSTGAVTSGYYPN |
| 343 | | CDR-L2 of F6A | artificial | GTKFLAP |
| 344 | | CDR-L3 of F6A | artificial | ALWYSNRWV |
| 345 | | CDR-H1 of F6A | artificial | IYAMN |
| 346 | | CDR-H2 of F6A | artificial | RIRSKYNNYATYYADSVKS |
| 347 | | CDR-H3 of F6A | artificial | HGNFGNSYVSFFAY |
| 348 | | VH of F6A | artificial | EVQLVESGGGLVQPGGSLKLSCAASGFTFNIYAMNWVRQAPGKGLEWVARIRSKYNNYATYY ADSVKSRFTISRDDSKNTAYLQMNNLKTEDTAVYYCVRHGNFGNSYVSFFAYWGQGTLVTVS S |
| 349 | | VL of F6A | artificial | QTVVTQEPSLTVSPGGTVTLTCGSSTGAVTSGYYPNWVQQKPGQAPRGLIGGTKFLAPGTPA RFSGSLLGGKAALTLSGVQPEDEAEYYCALWYSNRWVFGGGTKLTVL |
| 350 | | VH-VL of F6A | artificial | EVQLVESGGGLVQPGGSLKLSCAASGFTFNIYAMNWVRQAPGKGLEWVARIRSKYNNYATYY ADSVKSRFTISRDDSKNTAYLQMNNLKTEDTAVYYCVRHGNFGNSYVSFFAYWGQGTLVTVS |

TABLE 18-continued

| SEQ ID NO | DLL3-epitope | Designation | Format / Source | Amino acid sequence |
|---|---|---|---|---|
| | | | | SGGGGSGGGGSGGGGSQTVVTQEPSLTVSPGGTVTLTCGSSTGAVTSGYYPNWVQQKPGQAP RGLIGGTKFLAPGTPARFSGSLLGGKAALTLSGVQPEDEAEYYCALWYSNRWVFGGGTKLTV L |
| 351 | | CDR-L1 of H2C | artificial | GSSTGAVTSGYYPN |
| 352 | | CDR-L2 of H2C | artificial | GTKFLAP |
| 353 | | CDR-L3 of H2C | artificial | ALWYSNRWV |
| 354 | | CDR-H1 of H2C | artificial | KYAMN |
| 355 | | CDR-H2 of H2C | artificial | RIRSKYNNYATYYADSVKD |
| 356 | | CDR-H3 of H2C | artificial | HGNFGNSYISYWAY |
| 357 | | VH of H2C | artificial | EVQLVESGGGLVQPGGSLKLSCAASGFTFNKYAMNWVRQAPGKGLEWVARIRSKYNNYATYY ADSVKDRFTISRDDSKNTAYLQMNNLKTEDTAVYYCVRHGNFGNSYISYWAYWGQGTLVTVS S |
| 358 | | VL of H2C | artificial | QTVVTQEPSLTVSPGGTVTLTCGSSTGAVTSGYYPNWVQQKPGQAPRGLIGGTKFLAPGTPA RFSGSLLGGKAALTLSGVQPEDEAEYYCALWYSNRWVFGGGTKLTVL |
| 359 | | VH-VL of H2C | artificial | EVQLVESGGGLVQPGGSLKLSCAASGFTFNKYAMNWVRQAPGKGLEWVARIRSKYNNYATYY ADSVKDRFTISRDDSKNTAYLQMNNLKTEDTAVYYCVRHGNFGNSYISYWAYWGQGTLVTVS SGGGGSGGGGSGGGGSQTVVTQEPSLTVSPGGTVTLTCGSSTGAVTSGYYPNWVQQKPGQAP RGLIGGTKFLAPGTPARFSGSLLGGKAALTLSGVQPEDEAEYYCALWYSNRWVFGGGTKLTV L |
| 360 | | CDR-L1 of H1E | artificial | GSSTGAVTSGYYPN |
| 361 | | CDR-L2 of H1E | artificial | GTKFLAP |
| 362 | | CDR-L3 of H1E | artificial | ALWYSNRWV |
| 363 | | CDR-H1 of H1E | artificial | SYAMN |
| 364 | | CDR-H2 of H1E | artificial | RIRSKYNNYATYYADSVKG |
| 365 | | CDR-H3 of H1E | artificial | HGNFGNSYLSFWAY |
| 366 | | VH of H1E | artificial | EVQLVESGGGLEQPGGSLKLSCAASGFTFNSYAMNWVRQAPGKGLEWVARIRSKYNNYATYY ADSVKGRFTISRDDSKNTAYLQMNNLKTEDTAVYYCVRHGNFGNSYLSFWAYWGQGTLVTVS S |
| 367 | | VL of H1E | artificial | QTVVTQEPSLTVSPGGTVTLTCGSSTGAVTSGYYPNWVQQKPGQAPRGLIGGTKFLAPGTPA RFSGSLLGGKAALTLSGVQPEDEAEYYCALWYSNRWVFGGGTKLTVL |
| 368 | | VH-VL of H1E | artificial | EVQLVESGGGLEQPGGSLKLSCAASGFTFNSYAMNWVRQAPGKGLEWVARIRSKYNNYATYY ADSVKGRFTISRDDSKNTAYLQMNNLKTEDTAVYYCVRHGNFGNSYLSFWAYWGQGTLVTVS SGGGGSGGGGSGGGGSQTVVTQEPSLTVSPGGTVTLTCGSSTGAVTSGYYPNWVQQKPGQAP RGLIGGTKFLAPGTPARFSGSLLGGKAALTLSGVQPEDEAEYYCALWYSNRWVFGGGTKLTV L |
| 369 | | CDR-L1 of G4H | artificial | GSSTGAVTSGYYPN |
| 370 | | CDR-L2 of G4H | artificial | GTKFLAP |
| 371 | | CDR-L3 of G4H | artificial | ALWYSNRWV |

TABLE 18-continued

| SEQ ID NO | DLL3-epitope Designation | Format / Source | Amino acid sequence |
|---|---|---|---|
| 372 | CDR-H1 of G4H | artificial | RYAMN |
| 373 | CDR-H2 of G4H | artificial | RIRSKYNNYATYYADSVKG |
| 374 | CDR-H3 of G4H | artificial | HGNFGNSYLSYFAY |
| 375 | VH of G4H | artificial | EVQLVESGGGLVQPGGSLKLSCAASGFTFNRYAMNWVRQAPGKGLEWVARIRSKYNNYATYYADSVKGRFTISRDDSKNTAYLQMNNLKTEDTAVYYCVRHGNFGNSYLSYFAYWGQGTLVTVSS |
| 376 | VL of G4H | artificial | QTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL |
| 377 | VH-VL of G4H | artificial | EVQLVESGGGLVQPGGSLKLSCAASGFTFNRYAMNWVRQAPGKGLEWVARIRSKYNNYATYYADSVKGRFTISRDDSKNTAYLQMNNLKTEDTAVYYCVRHGNFGNSYLSYFAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL |
| 378 | CDR-L1 of A2J | artificial | RSSTGAVTSGYYPN |
| 379 | CDR-L2 of A2J | artificial | ATDMRPS |
| 380 | CDR-L3 of A2J | artificial | ALWYSNRWV |
| 381 | CDR-H1 of A2J | artificial | VYAMN |
| 382 | CDR-H2 of A2J | artificial | RIRSKYNNYATYYADSVKK |
| 383 | CDR-H3 of A2J | artificial | HGNFGNSYLSWWAY |
| 384 | VH of A2J | artificial | EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYLSWWAYWGQGTLVTVSS |
| 385 | VL of A2J | artificial | QTVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL |
| 386 | VH-VL of A2J | artificial | EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYLSWWAYWGQGTLVTVSSGGGGSGGGGSGGGGSQTVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL |
| 387 | CDR-L1 of E1L | artificial | GSSTGAVTSGYYPN |
| 388 | CDR-L2 of E1L | artificial | GTKFLAP |
| 389 | CDR-L3 of E1L | artificial | ALWYSNRWV |
| 390 | CDR-H1 of E1L | artificial | KYAMN |
| 391 | CDR-H2 of E1L | artificial | RIRSKYNNYATYYADSVKS |
| 392 | CDR-H3 of E1L | artificial | HGNFGNSYTSYYAY |
| 393 | VH of E1L | artificial | EVQLVESGGGLVQPGGSLKLSCAASGFTFNKYAMNWVRQAPGKGLEWVARIRSKYNNYATYYADSVKSRFTISRDDSKNTAYLQMNNLKTEDTAVYYCVRHGNFGNSYTSYYAYWGQGTLVTVSS |

TABLE 18-continued

| SEQ ID NO | DLL3-epitope Designation | Format / Source | Amino acid sequence |
|---|---|---|---|
| 394 | VL of E1L | artificial | QTVVTQEPSLTVSPGGTVTLTCGSSTGAVTSGYYPNWVQQKPGQAPRGLIGGTKFLAPGTPA RFSGSLLGGKAALTLSGVQPEDEAEYYCALWYSNRWVFGGGTKLTVL |
| 395 | VH-VL of E1L | artificial | EVQLVESGGGLVQPGGSLKLSCAASGFTFNKYAMNWVRQAPGKGLEWVARIRSKYNNYATYY ADSVKSRFTISRDDSKNTAYLQMNNLKTEDTAVYYCVRHGNFGNSYTSYYAYWGQGTLVTVS SGGGGSGGGGSGGGGSQTVVTQEPSLTVSPGGTVTLTCGSSTGAVTSGYYPNWVQQKPGQAP RGLIGGTKFLAPGTPARFSGSLLGGKAALTLSGVQPEDEAEYYCALWYSNRWVFGGGTKLTV L |
| 396 | CDR-L1 of E2M | artificial | RSSTGAVTSGYYPN |
| 397 | CDR-L2 of E2M | artificial | ATDMRPS |
| 398 | CDR-L3 of E2M | artificial | ALWYSNRWV |
| 399 | CDR-H1 of E2M | artificial | GYAMN |
| 400 | CDR-H2 of E2M | artificial | RIRSKYNNYATYYADSVKE |
| 401 | CDR-H3 of E2M | artificial | HRNFGNSYLSWFAY |
| 402 | VH of E2M | artificial | EVQLVESGGGLVQPGGSLKLSCAASGFTFNGYAMNWVRQAPGKGLEWVARIRSKYNNYATYY ADSVKERFTISRDDSKNTAYLQMNNLKTEDTAVYYCVRHRNFGNSYLSWFAYWGQGTLVTVS S |
| 403 | VL of E2M | artificial | QTVVTQEPSLTVSPGGTVTLTCRSSTGAVTSGYYPNWVQQKPGQAPRGLIGATDMRPSGTPA RFSGSLLGGKAALTLSGVQPEDEAEYYCALWYSNRWVFGGGTKLTVL |
| 404 | VH-VL of E2M | artificial | EVQLVESGGGLVQPGGSLKLSCAASGFTFNGYAMNWVRQAPGKGLEWVARIRSKYNNYATYY ADSVKERFTISRDDSKNTAYLQMNNLKTEDTAVYYCVRHRNFGNSYLSWFAYWGQGTLVTVS SGGGGSGGGGSGGGGSQTVVTQEPSLTVSPGGTVTLTCRSSTGAVTSGYYPNWVQQKPGQAP RGLIGATDMRPSGTPARFSGSLLGGKAALTLSGVQPEDEAEYYCALWYSNRWVFGGGTKLTV L |
| 405 | CDR-L1 of F70 | artificial | GSSTGAVTSGYYPN |
| 406 | CDR-L2 of F70 | artificial | GTKFLAP |
| 407 | CDR-L3 of F70 | artificial | ALWYSNRWV |
| 408 | CDR-H1 of F70 | artificial | VYAMN |
| 409 | CDR-H2 of F70 | artificial | RIRSKYNNYATYYADSVKK |
| 410 | CDR-H3 of F70 | artificial | HGNFGNSYISWWAY |
| 411 | VH of F70 | artificial | EVQLVESGGGLVQPGGSLKLSCAASGFTFNVYAMNWVRQAPGKGLEWVARIRSKYNNYATYY ADSVKKRFTISRDDSKNTAYLQMNNLKTEDTAVYYCVRHGNFGNSYISWWAYWGQGTLVTVS S |
| 412 | VL of F70 | artificial | QTVVTQEPSLTVSPGGTVTLTCGSSTGAVTSGYYPNWVQQKPGQAPRGLIGGTKFLAPGTPA RFSGSLLGGKAALTLSGVQPEDEAEYYCALWYSNRWVFGGGTKLTVL |
| 413 | VH-VL of F70 | artificial | EVQLVESGGGLVQPGGSLKLSCAASGFTFNVYAMNWVRQAPGKGLEWVARIRSKYNNYATYY ADSVKKRFTISRDDSKNTAYLQMNNLKTEDTAVYYCVRHGNFGNSYISWWAYWGQGTLVTVS SGGGGSGGGGSGGGGSQTVVTQEPSLTVSPGGTVTLTCGSSTGAVTSGYYPNWVQQKPGQAP RGLIGGTKFLAPGTPARFSGSLLGGKAALTLSGVQPEDEAEYYCALWYSNRWVFGGGTKLTV L |
| 414 | CDR-L1 of F12Q | artificial | GSSTGAVTSGNYPN |
| 415 | CDR-L2 of F12Q | artificial | GTKFLAP |

TABLE 18-continued

| SEQ ID NO | DLL3-epitope Designation | Format / Source | Amino acid sequence |
|---|---|---|---|
| 416 | CDR-L3 of F12Q | artificial | VLWYSNRWV |
| 417 | CDR-H1 of F12Q | artificial | SYAMN |
| 418 | CDR-H2 of F12Q | artificial | RIRSKYNNYATYYADSVKG |
| 419 | CDR-H3 of F12Q | artificial | HGNFGNSYVSWWAY |
| 420 | VH of F12Q | artificial | EVQLVESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSS |
| 421 | VL of F12Q | artificial | QTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 422 | VH-VL of F12Q | artificial | EVQLVESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 423 | CDR-L1 of I2C | artificial | GSSTGAVTSGNYPN |
| 424 | CDR-L2 of I2C | artificial | GTKFLAP |
| 425 | CDR-L3 of I2C | artificial | VLWYSNRWV |
| 426 | CDR-H1 of I2C | artificial | KYAMN |
| 427 | CDR-H2 of I2C | artificial | RIRSKYNNYATYYADSVKD |
| 428 | CDR-H3 of I2C | artificial | HGNFGNSYISYWAY |
| 429 | VH of I2C | artificial | EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSS |
| 430 | VL of I2C | artificial | QTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 431 | VH VL of I2C | artificial | EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 432 | VH of F12q | artificial | EVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSS |
| 433 | VL of F12q | artificial | QTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 434 | VH VL of F12q | artificial | EVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 435 | DLL3-4-001 (G44C) | VH | QVQLQESGPGLVKPSETLSLTCTVSGGSISSYYWSWIRQPPGKCLEWIGYVYYSGTTNYNPSLKSRVTISVDTSKNQFSLKLSSVTAADTAVYYCASIAVTGFYFDWGQGTLVTVSS |

TABLE 18-continued

| SEQ ID NO | DLL3-epitope Designation | Format / Source | Amino acid sequence |
|---|---|---|---|
| 436 | DLL3-4-001 (G234C) | VL | EIVLTQSPGTLSLSPGERVTLSCRASQRVNNNYLAWYQQRPGQAPRLLIYGASSRATGIPDR FSGSGSGTDFTLTISRLEPEDFAVYYCQQYDRSPLTFGCGTKLEIK |
| 437 | DLL3-4-001 (G44C-G243C) | scFv | QVQLQESGPGLVKPSETLSLTCTVSGGSISSYYWSWIRQPPGKCLEWIGYVYYSGTTNYNPS LKSRVTISVDTSKNQFSLKLSSVTAADTAVYYCASIAVTGFYFDYWGQGTLVTVSSGGGGSG GGGSGGGGSEIVLTQSPGTLSLSPGERVTLSCRASQRVNNNYLAWYQQRPGQAPRLLIYGAS SRATGIPDRFSGSGSGTDFTLTISRLEPEDFAVYYCQQYDRSPLTFGCGTKLEIK |
| 438 | DLL3-4-001 (CC) xI2C | bispecific molecule | QVQLQESGPGLVKPSETLSLTCTVSGGSISSYYWSWIRQPPGKCLEWIGYVYYSGTTNYNPS LKSRVTISVDTSKNQFSLKLSSVTAADTAVYYCASIAVTGFYFDYWGQGTLVTVSSGGGGSG GGGSGGGGSEIVLTQSPGTLSLSPGERVTLSCRASQRVNNNYLAWYQQRPGQAPRLLIYGAS SRATGIPDRFSGSGSGTDFTLTISRLEPEDFAVYYCQQYDRSPLTFGCGTKLEIKSGGGGSE VQLVESGGGLVQPGGSLKLSCAASGFTFNKYAMNWVRQAPGKGLEWVARIRSKYNNYATYYA DSVKDRFTISRDDSKNTAYLQMNNLKTEDTAVYYCVRHGNFGNSYISYWAYWGQGTLVTVSS GGGGSGGGGSGGGGSQTVVTQEPSLTVSPGGTVTLTCGSSTGAVTSGNYPNWVQQKPGQAPR GLIGGTKFLAPGTPARFSGSLLGGKAALTLSGVQPEDEAEYYCVLWYSNRWVFGGGTKLTVL |
| 439 | DLL3-14-D55E | VH-CDR2 | IINPSEGSTSYAQKFQG |
| 440 | DLL3-14-G56A | VH-CDR2 | IINPSDASTSYAQKFQG |
| 441 | DLL3-14-D171E | VL-CDR1 | RSSQSLVYREGNTYLS |
| 442 | DLL3-14-G172A | VL-CDR1 | RSSQSLVYRDANTYLS |
| 443 | DLL3-14-N173Q | VL-CDR1 | RSSQSLVYRDGQTYLS |
| 444 | DLL3-14-T174A | VL-CDR1 | RSSQSLVYRDGNAYLS |
| 445 | DLL3-14-L43Q | VH | QVQLVQSGAEVKKPGASVKVSCKASGYTFTNYYMHWVRQAPGQGLEWMGIINPSDGSTSYAQ KFQGRVTMTRDTSTNTVYMDLSSLRSEDTAVYYCARGGNSAFYSYYDMDVWGQGTTVTVSS |
| 446 | DLL3-14-D55E | VH | QVQLVQSGAEVKKPGASVKVSCKASGYTFTNYYMHWVRQAPGLGLEWMGIINPSEGSTSYAQ KFQGRVTMTRDTSTNTVYMDLSSLRSEDTAVYYCARGGNSAFYSYYDMDVWGQGTTVTVSS |
| 447 | DLL3-14-G56A | VH | QVQLVQSGAEVKKPGASVKVSCKASGYTFTNYYMHWVRQAPGLGLEWMGIINPSDASTSYAQ KFQGRVTMTRDTSTNTVYMDLSSLRSEDTAVYYCARGGNSAFYSYYDMDVWGQGTTVTVSS |
| 448 | DLL3-14-L43Q-D55E | VH | QVQLVQSGAEVKKPGASVKVSCKASGYTFTNYYMHWVRQAPGQGLEWMGIINPSEGSTSYAQ KFQGRVTMTRDTSTNTVYMDLSSLRSEDTAVYYCARGGNSAFYSYYDMDVWGQGTTVTVSS |
| 449 | DLL3-14-L43Q-G56A | VH | QVQLVQSGAEVKKPGASVKVSCKASGYTFTNYYMHWVRQAPGQGLEWMGIINPSDASTSYAQ KFQGRVTMTRDTSTNTVYMDLSSLRSEDTAVYYCARGGNSAFYSYYDMDVWGQGTTVTVS |
| 450 | DLL3-14-G44C | VH | QVQLVQSGAEVKKPGASVKVSCKASGYTFTNYYMHWVRQAPGLCLEWMGIINPSDGSTSYAQ KFQGRVTMTRDTSTNTVYMDLSSLRSEDTAVYYCARGGNSAFYSYYDMDVWGQGTTVTVSS |
| 451 | DLL3-14-L43-Q-G44C | VH | QVQLVQSGAEVKKPGASVKVSCKASGYTFTNYYMHWVRQAPGQCLEWMGIINPSDGSTSYAQ KFQGRVTMTRDTSTNTVYMDLSSLRSEDTAVYYCARGGNSAFYSYYDMDVWGQGTTVTVSS |
| 452 | DLL3-14-G44C-D55E | VH | QVQLVQSGAEVKKPGASVKVSCKASGYTFTNYYMHWVRQAPGLCLEWMGIINPSEGSTSYAQ KFQGRVTMTRDTSTNTVYMDLSSLRSEDTAVYYCARGGNSAFYSYYDMDVWGQGTTVTVSS |
| 453 | DLL3-14-G44C-G56A | VH | QVQLVQSGAEVKKPGASVKVSCKASGYTFTNYYMHWVRQAPGLCLEWMGIINPSDASTSYAQ KFQGRVTMTRDTSTNTVYMDLSSLRSEDTAVYYCARGGNSAFYSYYDMDVWGQGTTVTVSS |
| 454 | DLL3-14-L43Q-G44C-D55E | VH | QVQLVQSGAEVKKPGASVKVSCKASGYTFTNYYMHWVRQAPGQCLEWMGIINPSEGSTSYAQ KFQGRVTMTRDTSTNTVYMDLSSLRSEDTAVYYCARGGNSAFYSYYDMDVWGQGTTVTVSS |
| 455 | DLL3-14-L43Q-G44C-G56A | VH | QVQLVQSGAEVKKPGASVKVSCKASGYTFTNYYMHWVRQAPGQCLEWMGIINPSDASTSYAQ KFQGRVTMTRDTSTNTVYMDLSSLRSEDTAVYYCARGGNSAFYSYYDMDVWGQGTTVTVSS |
| 456 | DLL3-14-D171E | VL | DVVMTQTPLSLPVTLGQPASISCRSSQSLVYREGNTYLSWFQQRPGQSPRRLIYKVSNWQSG VPDRFSGGGSGTDFTLKISRVEAEDVGVYYCMQGTHWPPTFGQGTKVEIK |
| 457 | DLL3-14-G172A | VL | DVVMTQTPLSLPVTLGQPASISCRSSQSLVYRDANTYLSWFQQRPGQSPRRLIYKVSNWQSG VPDRFSGGGSGTDFTLKISRVEAEDVGVYYCMQGTHWPPTFGQGTKVEIK |

TABLE 18-continued

| SEQ ID NO | DLL3-epi-tope | Desig-nation | Format / Source | Amino acid sequence |
|---|---|---|---|---|
| 458 | | DLL3-14-N173Q | VL | DVVMTQTPLSLPVTLGQPASISCRSSQSLVYRDGQTYLSWFQQRPGQSPRRLIYKVSNWQSGVPDRFSGGGSGTDFTLKISRVEAEDVGVYYCMQGTHWPPTFGQGTKVEIK |
| 459 | | DLL3-14-T174A | VL | DVVMTQTPLSLPVTLGQPASISCRSSQSLVYRDGNAYLSWFQQRPGQSPRRLIYKVSNWQSGVPDRFSGGGSGTDFTLKISRVEAEDVGVYYCMQGTHWPPTFGQGTKVEIK |
| 460 | | DLL3-14-G208S | VL | DVVMTQTPLSLPVTLGQPASISCRSSQSLVYRDGNTYLSWFQQRPGQSPRRLIYKVSNWQSGVPDRFSGSGSGTDFTLKISRVEAEDVGVYYCMQGTHWPPTFGQGTKVEIK |
| 461 | | DLL3-14-D171E-G208S | VL | DVVMTQTPLSLPVTLGQPASISCRSSQSLVYREGNTYLSWFQQRPGQSPRRLIYKVSNWQSGVPDRFSGSGSGTDFTLKISRVEAEDVGVYYCMQGTHWPPTFGQGTKVEIK |
| 462 | | DLL3-14-G172A-G208S | VL | DVVMTQTPLSLPVTLGQPASISCRSSQSLVYRDANTYLSWFQQRPGQSPRRLIYKVSNWQSGVPDRFSGSGSGTDFTLKISRVEAEDVGVYYCMQGTHWPPTFGQGTKVEIK |
| 463 | | DLL3-14-Q243C | VL | DVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGCGTKVEIK |
| 464 | | DLL3-14-D171E-Q243C | VL | DVVMTQTPLSLPVTLGQPASISCRSSQSLVYREGNTYLSWFQQRPGQSPRRLIYKVSNWQSGVPDRFSGGGSGTDFTLKISRVEAEDVGVYYCMQGTHWPPTFGCGTKVEIK |
| 465 | | DLL3-14-G172A-Q243C | VL | DVVMTQTPLSLPVTLGQPASISCRSSQSLVYRDANTYLSWFQQRPGQSPRRLIYKVSNWQSGVPDRFSGGGSGTDFTLKISRVEAEDVGVYYCMQGTHWPPTFGCGTKVEIK |
| 466 | | DLL3-14-N173Q Q243C | VL | DVVMTQTPLSLPVTLGQPASISCRSSQSLVYRDGQTYLSWFQQRPGQSPRRLIYKVSNWQSGVPDRFSGGGSGTDFTLKISRVEAEDVGVYYCMQGTHWPPTFGCGTKVEIK |
| 467 | | DLL3-14-T174A-Q243C | VL | DVVMTQTPLSLPVTLGQPASISCRSSQSLVYRDGNAYLSWFQQRPGQSPRRLIYKVSNWQSGVPDRFSGGGSGTDFTLKISRVEAEDVGVYYCMQGTHWPPTFGCGTKVEIK |
| 468 | | DLL3-14-G208S-Q243C | VL | DVVMTQTPLSLPVTLGQPASISCRSSQSLVYRDGNTYLSWFQQRPGQSPRRLIYKVSNWQSGVPDRFSGSGSGTDFTLKISRVEAEDVGVYYCMQGTHWPPTFGCGTKVEIK |
| 469 | | DLL3-14-D171E-G208S-Q243C | VL | DVVMTQTPLSLPVTLGQPASISCRSSQSLVYREGNTYLSWFQQRPGQSPRRLIYKVSNWQSGVPDRFSGSGSGTDFTLKISRVEAEDVGVYYCMQGTHWPPTFGCGTKVEIK |
| 470 | | DLL3-14-G172A-G208S-Q243C | VL | DVVMTQTPLSLPVTLGQPASISCRSSQSLVYRDANTYLSWFQQRPGQSPRRLIYKVSNWQSGVPDRFSGSGSGTDFTLKISRVEAEDVGVYYCMQGTHWPPTFGCGTKVEIK |
| 471 | | DLL3-14-001 | scFv | QVQLVQSGAEVKKPGASVKVSCKASGYTFTNYYMHWVRQAPGLGLEWMGIINPSDGSTSYAQKFQGRVTMTRDTSTNTVYMDLSSLRSEDTAVYYCARGGNSAFYSYYDMDVWGQGTTVTVSSGGGSGGGGSGGGGSDVVMTQTPLSLPVTLGQPASISCRSSQSLVYREGNTYLSWFQQRPGQSPRRLIYKVSNWQSGVPDRFSGGGSGTDFTLKISRVEAEDVGVYYCMQGTHWPPTFGQGTKVEIK |
| 472 | | DLL3-14-002 | scFv | QVQLVQSGAEVKKPGASVKVSCKASGYTFTNYYMHWVRQAPGLGLEWMGIINPSDGSTSYAQKFQGRVTMTRDTSTNTVYMDLSSLRSEDTAVYYCARGGNSAFYSYYDMDVWGQGTTVTVSSGGGSGGGGSGGGGSDVVMTQTPLSLPVTLGQPASISCRSSQSLVYRDANTYLSWFQQRPGQSPRRLIYKVSNWQSGVPDRFSGGGSGTDFTLKISRVEAEDVGVYYCMQGTHWPPTFGQGTKVEIK |
| 473 | | DLL3-14-003 | scFv | QVQLVQSGAEVKKPGASVKVSCKASGYTFTNYYMHWVRQAPGLGLEWMGIINPSDGSTSYAQKFQGRVTMTRDTSTNTVYMDLSSLRSEDTAVYYCARGGNSAFYSYYDMDVWGQGTTVTVSSGGGSGGGGSGGGGSDVVMTQTPLSLPVTLGQPASISCRSSQSLVYRDGQTYLSWFQQRPGQSPRRLIYKVSNWQSGVPDRFSGGGSGTDFTLKISRVEAEDVGVYYCMQGTHWPPTFGQGTKVEIK |
| 474 | | DLL3-14-004 | scFv | QVQLVQSGAEVKKPGASVKVSCKASGYTFTNYYMHWVRQAPGLGLEWMGIINPSDGSTSYAQKFQGRVTMTRDTSTNTVYMDLSSLRSEDTAVYYCARGGNSAFYSYYDMDVWGQGTTVTVSSGGGSGGGGSGGGGSDVVMTQTPLSLPVTLGQPASISCRSSQSLVYRDGNAYLSWFQQRPGQSPRRLIYKVSNWQSGVPDRFSGGGSGTDFTLKISRVEAEDVGVYYCMQGTHWPPTFGQGTKVEIK |

TABLE 18-continued

| SEQ ID NO | DLL3-epi-tope Desig-nation | Format / Source | Amino acid sequence |
|---|---|---|---|
| 475 | DLL3-14-005 | scFv | QVQLVQSGAEVKKPGASVKVSCKASGYTFTNYYMHWVRQAPGLGLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGSGSGTDFTLKISRVEAEDVGVYYCMQGTHWPPTFGQGTKVEIK |
| 476 | DLL3-14-006 | scFv | QVQLVQSGAEVKKPGASVKVSCKASGYTFTNYYMHWVRQAPGQGLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGQGTKVEIK |
| 477 | DLL3-14-007 | scFv | QVQLVQSGAEVKKPGASVKVSCKASGYTFTNYYMHWVRQAPGLGLEWMGIINPSEGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGQGTKVEIK |
| 478 | DLL3-14-008 | scFv | QVQLVQSGAEVKKPGASVKVSCKASGYTFTNYYMHWVRQAPGLGLEWMGIINPSDASTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGQGTKVEIK |
| 479 | DLL3-14-009 | scFv | QVQLVQSGAEVKKPGASVKVSCKASGYTFTNYYMHWVRQAPGQGLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGQGTKVEIK |
| 480 | DLL3-14-010 | scFv | QVQLVQSGAEVKKPGASVKVSCKASGYTFTNYYMHWVRQAPGQGLEWMGIINPSEGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYREGNTYLSWFQQRPGQSPRRLIYKVSNWQSGVPDRFSGGGSGTDFTLKISRVEAEDVGVYYCMQGTHWPPTFGQGTKVEIK |
| 481 | DLL3-14-011 | scFv | QVQLVQSGAEVKKPGASVKVSCKASGYTFTNYYMHWVRQAPGQGLEWMGIINPSDASTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDANTYLSWFQQRPGQSPRRLIYKVSNWQSGVPDRFSGGGSGTDFTLKISRVEAEDVGVYYCMQGTHWPPTFGQGTKVEIK |
| 482 | DLL3-14-012 (CC) | scFv | QVQLVQSGAEVKKPGASVKVSCKASGYTFTNYYMHWVRQAPGLCLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGCGTKVEIK |
| 483 | DLL3-14-013 | scFv | QVQLVQSGAEVKKPGASVKVSCKASGYTFTNYYMHWVRQAPGLCLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYREGNTYLSWFQQRPGQSPRRLIYKVSNWQSGVPDRFSGGGSGTDFTLKISRVEAEDVGVYYCMQGTHWPPTFGCGTKVEIK |
| 484 | DLL3-14-014 | scFv | QVQLVQSGAEVKKPGASVKVSCKASGYTFTNYYMHWVRQAPGLCLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDANTYLSWFQQRPGQSPRRLIYKVSNWQSGVPDRFSGGGSGTDFTLKISRVEAEDVGVYYCMQGTHWPPTFGCGTKVEIK |
| 485 | DLL3-14-015 | scFv | QVQLVQSGAEVKKPGASVKVSCKASGYTFTNYYMHWVRQAPGLCLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGQTYLSWFQQRPGQSPRRLIYKVSNWQSGVPDRFSGGGSGTDFTLKISRVEAEDVGVYYCMQGTHWPPTFGCGTKVEIK |
| 486 | DLL3-14-016 | scFv | QVQLVQSGAEVKKPGASVKVSCKASGYTFTNYYMHWVRQAPGLCLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNAYLSWFQQRPGQSPRRLIYKVSNWQSGVPDRFSGGGSGTDFTLKISRVEAEDVGVYYCMQGTHWPPTFGCGTKVEIK |

TABLE 18-continued

| SEQ ID NO | DLL3-epitope | Designation | Format / Source | Amino acid sequence |
|---|---|---|---|---|
| 487 | | DLL3-14-017- | scFv | QVQLVQSGAEVKKPGASVKVSCKASGYTFTNYYMHWVRQAPGLCLEWMGIINPSDGSTSYAQ KFQGRVTMTRDTSTNTVYMDLSSLRSEDTAVYYCARGGNSAFYSYYDMDVWGQGTTVTVSSG GGGSGGGGSGGGGSDVVMTQTPLSLPVTLGQPASISCRSSQSLVYRDGNTYLSWFQQRPGQS PRRLIYKVSNWQSGVPDRFSGSGSGTDFTLKISRVEAEDVGVYYCMQGTHWPPTFGCGTKVE IK |
| 488 | | DLL3-14-018 | scFv | QVQLVQSGAEVKKPGASVKVSCKASGYTFTNYYMHWVRQAPGQCLEWMGIINPSDGSTSYAQ KFQGRVTMTRDTSTNTVYMDLSSLRSEDTAVYYCARGGNSAFYSYYDMDVWGQGTTVTVSSG GGGSGGGGSGGGGSDVVMTQTPLSLPVTLGQPASISCRSSQSLVYRDGNTYLSWFQQRPGQS PRRLIYKVSNWQSGVPDRFSGGGSGTDFTLKISRVEAEDVGVYYCMQGTHWPPTFGCGTKVE IK |
| 489 | | DLL3-14-019 | scFv | QVQLVQSGAEVKKPGASVKVSCKASGYTFTNYYMHWVRQAPGLCLEWMGIINPSEGSTSYAQ KFQGRVTMTRDTSTNTVYMDLSSLRSEDTAVYYCARGGNSAFYSYYDMDVWGQGTTVTVSSG GGGSGGGGSGGGGSDVVMTQTPLSLPVTLGQPASISCRSSQSLVYRDGNTYLSWFQQRPGQS PRRLIYKVSNWQSGVPDRFSGGGSGTDFTLKISRVEAEDVGVYYCMQGTHWPPTFGCGTKVE IK |
| 490 | | DLL3-14-020 | scFv | QVQLVQSGAEVKKPGASVKVSCKASGYTFTNYYMHWVRQAPGLCLEWMGIINPSDASTSYAQ KFQGRVTMTRDTSTNTVYMDLSSLRSEDTAVYYCARGGNSAFYSYYDMDVWGQGTTVTVSSG GGGSGGGGSGGGGSDVVMTQTPLSLPVTLGQPASISCRSSQSLVYRDGNTYLSWFQQRPGQS PRRLIYKVSNWQSGVPDRFSGGGSGTDFTLKISRVEAEDVGVYYCMQGTHWPPTFGCGTKVE IK |
| 491 | | DLL3-14-021 | scFv | QVQLVQSGAEVKKPGASVKVSCKASGYTFTNYYMHWVRQAPGQCLEWMGIINPSDGSTSYAQ KFQGRVTMTRDTSTNTVYMDLSSLRSEDTAVYYCARGGNSAFYSYYDMDVWGQGTTVTVSSG GGGSGGGGSGGGGSDVVMTQTPLSLPVTLGQPASISCRSSQSLVYRDGNTYLSWFQQRPGQS PRRLIYKVSNWQSGVPDRFSGSGSGTDFTLKISRVEAEDVGVYYCMQGTHWPPTFGCGTKVE IK |
| 492 | | DLL3-14-022 | scFv | QVQLVQSGAEVKKPGASVKVSCKASGYTFTNYYMHWVRQAPGQCLEWMGIINPSEGSTSYAQ KFQGRVTMTRDTSTNTVYMDLSSLRSEDTAVYYCARGGNSAFYSYYDMDVWGQGTTVTVSSG GGGSGGGGSGGGGSDVVMTQTPLSLPVTLGQPASISCRSSQSLVYREGNTYLSWFQQRPGQS PRRLIYKVSNWQSGVPDRFSGSGSGTDFTLKISRVEAEDVGVYYCMQGTHWPPTFGCGTKVE IK |
| 493 | | DLL3-14-023 | scFv | QVQLVQSGAEVKKPGASVKVSCKASGYTFTNYYMHWVRQAPGQCLEWMGIINPSDASTSYAQ KFQGRVTMTRDTSTNTVYMDLSSLRSEDTAVYYCARGGNSAFYSYYDMDVWGQGTTVTVSSG GGGSGGGGSGGGGSDVVMTQTPLSLPVTLGQPASISCRSSQSLVYRDANTYLSWFQQRPGQS PRRLIYKVSNWQSGVPDRFSGSGSGTDFTLKISRVEAEDVGVYYCMQGTHWPPTFGCGTKVE IK |
| 494 | | DLL3-14-001 xI2C | bispecific molecule | QVQLVQSGAEVKKPGASVKVSCKASGYTFTNYYMHWVRQAPGLGLEWMGIINPSDGSTSYAQ KFQGRVTMTRDTSTNTVYMDLSSLRSEDTAVYYCARGGNSAFYSYYDMDVWGQGTTVTVSSG GGGSGGGGSGGGGSDVVMTQTPLSLPVTLGQPASISCRSSQSLVYREGNTYLSWFQQRPGQS PRRLIYKVSNWQSGVPDRFSGGGSGTDFTLKISRVEAEDVGVYYCMQGTHWPPTFGQGTKVE IKSGGGGSEVQLVESGGGLVQPGGSLKLSCAASGFTFNKYAMNWVRQAPGKGLEWVARIRSK YNNYATYYADSVKDRFTISRDDSKNTAYLQMNNLKTEDTAVYYCVRHGNFGNSYISYWAYWG QGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVF GGGTKLTVL |
| 495 | | DLL3-14-002 xI2C | bispecific molecule | QVQLVQSGAEVKKPGASVKVSCKASGYTFTNYYMHWVRQAPGLGLEWMGIINPSDGSTSYAQ KFQGRVTMTRDTSTNTVYMDLSSLRSEDTAVYYCARGGNSAFYSYYDMDVWGQGTTVTVSSG GGGSGGGGSGGGGSDVVMTQTPLSLPVTLGQPASISCRSSQSLVYRDANTYLSWFQQRPGQS PRRLIYKVSNWQSGVPDRFSGGGSGTDFTLKISRVEAEDVGVYYCMQGTHWPPTFGQGTKVE IKSGGGGSEVQLVESGGGLVQPGGSLKLSCAASGFTFNKYAMNWVRQAPGKGLEWVARIRSK YNNYATYYADSVKDRFTISRDDSKNTAYLQMNNLKTEDTAVYYCVRHGNFGNSYISYWAYWG QGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVF GGGTKLTVL |
| 496 | | DLL3-14-003 xI2C | bispecific molecule | QVQLVQSGAEVKKPGASVKVSCKASGYTFTNYYMHWVRQAPGLGLEWMGIINPSDGSTSYAQ KFQGRVTMTRDTSTNTVYMDLSSLRSEDTAVYYCARGGNSAFYSYYDMDVWGQGTTVTVSSG GGGSGGGGSGGGGSDVVMTQTPLSLPVTLGQPASISCRSSQSLVYRDGQTYLSWFQQRPGQS PRRLIYKVSNWQSGVPDRFSGGGSGTDFTLKISRVEAEDVGVYYCMQGTHWPPTFGQGTKVE IKSGGGGSEVQLVESGGGLVQPGGSLKLSCAASGFTFNKYAMNWVRQAPGKGLEWVARIRSK YNNYATYYADSVKDRFTISRDDSKNTAYLQMNNLKTEDTAVYYCVRHGNFGNSYISYWAYWG QGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVF GGGTKLTVL |
| 497 | | DLL3-14-004 xI2C | bispecific molecule | QVQLVQSGAEVKKPGASVKVSCKASGYTFTNYYMHWVRQAPGLGLEWMGIINPSDGSTSYAQ KFQGRVTMTRDTSTNTVYMDLSSLRSEDTAVYYCARGGNSAFYSYYDMDVWGQGTTVTVSSG GGGSGGGGSGGGGSDVVMTQTPLSLPVTLGQPASISCRSSQSLVYRDGNAYLSWFQQRPGQS PRRLIYKVSNWQSGVPDRFSGGGSGTDFTLKISRVEAEDVGVYYCMQGTHWPPTFGQGTKVE |

TABLE 18-continued

| SEQ ID NO | DLL3-epitope Designation | Format / Source | Amino acid sequence |
|---|---|---|---|
| | | | IKSGGGGSEVQLVESGGGLVQPGGSLKLSCAASGFTFNKYAMNWVRQAPGKGLEWVARIRSK YNNYATYYADSVKDRFTISRDDSKNTAYLQMNNLKTEDTAVYYCVRHGNFGNSYISYWAYWG QGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVF GGGTKLTVL |
| 498 | DLL3-14-005 xI2C | bispecific molecule | QVQLVQSGAEVKKPGASVKVSCKASGYTFTNYYMHWVRQAPGLGLEWMGIINPSDGSTSYAQ KFQGRVTMTRDTSTNTVYMDLSSLRSEDTAVYYCARGGNSAFYSYYDMDVWGQGTTVTVSSG GGGSGGGGSGGGGSDVVMTQTPLSLPVTLGQPASISCRSSQSLVYRDGNTYLSWFQQRPGQS PRRLIYKVSNWQSGVPDRFSGGGSGTDFTLKISRVEAEDVGVYYCMQGTHWPPTFGQGTKVE IKSGGGGSEVQLVESGGGLVQPGGSLKLSCAASGFTFNKYAMNWVRQAPGKGLEWVARIRSK YNNYATYYADSVKDRFTISRDDSKNTAYLQMNNLKTEDTAVYYCVRHGNFGNSYISYWAYWG QGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVF GGGTKLTVL |
| 499 | DLL3-14-006 xI2C | bispecific molecule | QVQLVQSGAEVKKPGASVKVSCKASGYTFTNYYMHWVRQAPGQGLEWMGIINPSDGSTSYAQ KFQGRVTMTRDTSTNTVYMDLSSLRSEDTAVYYCARGGNSAFYSYYDMDVWGQGTTVTVSSG GGGSGGGGSGGGGSDVVMTQTPLSLPVTLGQPASISCRSSQSLVYRDGNTYLSWFQQRPGQS PRRLIYKVSNWQSGVPDRFSGGGSGTDFTLKISRVEAEDVGVYYCMQGTHWPPTFGQGTKVE IKSGGGGSEVQLVESGGGLVQPGGSLKLSCAASGFTFNKYAMNWVRQAPGKGLEWVARIRSK YNNYATYYADSVKDRFTISRDDSKNTAYLQMNNLKTEDTAVYYCVRHGNFGNSYISYWAYWG QGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVF GGGTKLTVL |
| 500 | DLL3-14-007 xI2C | bispecific molecule | QVQLVQSGAEVKKPGASVKVSCKASGYTFTNYYMHWVRQAPGLGLEWMGIINPSEGSTSYAQ KFQGRVTMTRDTSTNTVYMDLSSLRSEDTAVYYCARGGNSAFYSYYDMDVWGQGTTVTVSSG GGGSGGGGSGGGGSDVVMTQTPLSLPVTLGQPASISCRSSQSLVYRDGNTYLSWFQQRPGQS PRRLIYKVSNWQSGVPDRFSGGGSGTDFTLKISRVEAEDVGVYYCMQGTHWPPTFGQGTKVE IKSGGGGSEVQLVESGGGLVQPGGSLKLSCAASGFTFNKYAMNWVRQAPGKGLEWVARIRSK YNNYATYYADSVKDRFTISRDDSKNTAYLQMNNLKTEDTAVYYCVRHGNFGNSYISYWAYWG QGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVF GGGTKLTVL |
| 501 | DLL3-14-008 xI2C | bispecific molecule | QVQLVQSGAEVKKPGASVKVSCKASGYTFTNYYMHWVRQAPGLGLEWMGIINPSDASTSYAQ KFQGRVTMTRDTSTNTVYMDLSSLRSEDTAVYYCARGGNSAFYSYYDMDVWGQGTTVTVSSG GGGSGGGGSGGGGSDVVMTQTPLSLPVTLGQPASISCRSSQSLVYRDGNTYLSWFQQRPGQS PRRLIYKVSNWQSGVPDRFSGGGSGTDFTLKISRVEAEDVGVYYCMQGTHWPPTFGQGTKVE IKSGGGGSEVQLVESGGGLVQPGGSLKLSCAASGFTFNKYAMNWVRQAPGKGLEWVARIRSK YNNYATYYADSVKDRFTISRDDSKNTAYLQMNNLKTEDTAVYYCVRHGNFGNSYISYWAYWG QGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVF GGGTKLTVL |
| 502 | DLL3-14-009 xI2C | bispecific molecule | QVQLVQSGAEVKKPGASVKVSCKASGYTFTNYYMHWVRQAPGQGLEWMGIINPSDGSTSYAQ KFQGRVTMTRDTSTNTVYMDLSSLRSEDTAVYYCARGGNSAFYSYYDMDVWGQGTTVTVSSG GGGSGGGGSGGGGSDVVMTQTPLSLPVTLGQPASISCRSSQSLVYRDGNTYLSWFQQRPGQS PRRLIYKVSNWQSGVPDRFSGGGSGTDFTLKISRVEAEDVGVYYCMQGTHWPPTFGQGTKVE IKSGGGGSEVQLVESGGGLVQPGGSLKLSCAASGFTFNKYAMNWVRQAPGKGLEWVARIRSK YNNYATYYADSVKDRFTISRDDSKNTAYLQMNNLKTEDTAVYYCVRHGNFGNSYISYWAYWG QGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVF GGGTKLTVL |
| 503 | DLL3-14-010 xI2C | bispecific molecule | QVQLVQSGAEVKKPGASVKVSCKASGYTFTNYYMHWVRQAPGQGLEWMGIINPSEGSTSYAQ KFQGRVTMTRDTSTNTVYMDLSSLRSEDTAVYYCARGGNSAFYSYYDMDVWGQGTTVTVSSG GGGSGGGGSGGGGSDVVMTQTPLSLPVTLGQPASISCRSSQSLVYREGNTYLSWFQQRPGQS PRRLIYKVSNWQSGVPDRFSGSGSGTDFTLKISRVEAEDVGVYYCMQGTHWPPTFGQGTKVE IKSGGGGSEVQLVESGGGLVQPGGSLKLSCAASGFTFNKYAMNWVRQAPGKGLEWVARIRSK YNNYATYYADSVKDRFTISRDDSKNTAYLQMNNLKTEDTAVYYCVRHGNFGNSYISYWAYWG QGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVF GGGTKLTVL |
| 504 | DLL3-14-011 xI2C | bispecific molecule | QVQLVQSGAEVKKPGASVKVSCKASGYTFTNYYMHWVRQAPGQGLEWMGIINPSDASTSYAQ KFQGRVTMTRDTSTNTVYMDLSSLRSEDTAVYYCARGGNSAFYSYYDMDVWGQGTTVTVSSG GGGSGGGGSGGGGSDVVMTQTPLSLPVTLGQPASISCRSSQSLVYRDANTYLSWFQQRPGQS PRRLIYKVSNWQSGVPDRFSGGGSGTDFTLKISRVEAEDVGVYYCMQGTHWPPTFGQGTKVE IKSGGGGSEVQLVESGGGLVQPGGSLKLSCAASGFTFNKYAMNWVRQAPGKGLEWVARIRSK YNNYATYYADSVKDRFTISRDDSKNTAYLQMNNLKTEDTAVYYCVRHGNFGNSYISYWAYWG QGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVF GGGTKLTVL |

TABLE 18-continued

| SEQ ID NO | DLL3-epitope Designation | Format / Source | Amino acid sequence |
|---|---|---|---|
| 505 | DLL3-14-012 (CC) xI2C | bispecific molecule | QVQLVQSGAEVKKPGASVKVSCKASGYTFTNYYMHWVRQAPGLCLEWMGIINPSDGSTSYAQ KFQGRVTMTRDTSTNTVYMDLSSLRSEDTAVYYCARGGNSAFYSYYDMDVWGQGTTVTVSSG GGGSGGGGSGGGGSDVVMTQTPLSLPVTLGQPASISCRSSQSLVYRDGNTYLSWFQQRPGQS PRRLIYKVSNWQSGVPDRFSGGGSGTDFTLKISRVEAEDVGVYYCMQGTHWPPTFGCGTKVE IKSGGGGSEVQLVESGGGLVQPGGSLKLSCAASGFTFNKYAMNWVRQAPGKGLEWVARIRSK YNNYATYYADSVKDRFTISRDDSKNTAYLQMNNLKTEDTAVYYCVRHGNFGNSYISYWAYWG QGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVF GGGTKLTVL |
| 506 | DLL3-14-013 xI2C | bispecific molecule | QVQLVQSGAEVKKPGASVKVSCKASGYTFTNYYMHWVRQAPGLCLEWMGIINPSDGSTSYAQ KFQGRVTMTRDTSTNTVYMDLSSLRSEDTAVYYCARGGNSAFYSYYDMDVWGQGTTVTVSSG GGGSGGGGSGGGGSDVVMTQTPLSLPVTLGQPASISCRSSQSLVYREGNTYLSWFQQRPGQS PRRLIYKVSNWQSGVPDRFSGGGSGTDFTLKISRVEAEDVGVYYCMQGTHWPPTFGCGTKVE IKSGGGGSEVQLVESGGGLVQPGGSLKLSCAASGFTFNKYAMNWVRQAPGKGLEWVARIRSK YNNYATYYADSVKDRFTISRDDSKNTAYLQMNNLKTEDTAVYYCVRHGNFGNSYISYWAYWG QGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVF GGGTKLTVL |
| 507 | DLL3-14-014 xI2C | bispecific molecule | QVQLVQSGAEVKKPGASVKVSCKASGYTFTNYYMHWVRQAPGLCLEWMGIINPSDGSTSYAQ KFQGRVTMTRDTSTNTVYMDLSSLRSEDTAVYYCARGGNSAFYSYYDMDVWGQGTTVTVSSG GGGSGGGGSGGGGSDVVMTQTPLSLPVTLGQPASISCRSSQSLVYRDANTYLSWFQQRPGQS PRRLIYKVSNWQSGVPDRFSGGGSGTDFTLKISRVEAEDVGVYYCMQGTHWPPTFGCGTKVE IKSGGGGSEVQLVESGGGLVQPGGSLKLSCAASGFTFNKYAMNWVRQAPGKGLEWVARIRSK YNNYATYYADSVKDRFTISRDDSKNTAYLQMNNLKTEDTAVYYCVRHGNFGNSYISYWAYWG QGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVF GGGTKLTVL |
| 508 | DLL3-14-015 xI2C | bispecific molecule | QVQLVQSGAEVKKPGASVKVSCKASGYTFTNYYMHWVRQAPGLCLEWMGIINPSDGSTSYAQ KFQGRVTMTRDTSTNTVYMDLSSLRSEDTAVYYCARGGNSAFYSYYDMDVWGQGTTVTVSSG GGGSGGGGSGGGGSDVVMTQTPLSLPVTLGQPASISCRSSQSLVYRDGQTYLSWFQQRPGQS PRRLIYKVSNWQSGVPDRFSGGGSGTDFTLKISRVEAEDVGVYYCMQGTHWPPTFGCGTKVE IKSGGGGSEVQLVESGGGLVQPGGSLKLSCAASGFTFNKYAMNWVRQAPGKGLEWVARIRSK YNNYATYYADSVKDRFTISRDDSKNTAYLQMNNLKTEDTAVYYCVRHGNFGNSYISYWAYWG QGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVF GGGTKLTVL |
| 509 | DLL3-14-016 xI2C | bispecific molecule | QVQLVQSGAEVKKPGASVKVSCKASGYTFTNYYMHWVRQAPGLCLEWMGIINPSDGSTSYAQ KFQGRVTMTRDTSTNTVYMDLSSLRSEDTAVYYCARGGNSAFYSYYDMDVWGQGTTVTVSSG GGGSGGGGSGGGGSDVVMTQTPLSLPVTLGQPASISCRSSQSLVYRDGNAYLSWFQQRPGQS PRRLIYKVSNWQSGVPDRFSGGGSGTDFTLKISRVEAEDVGVYYCMQGTHWPPTFGCGTKVE IKSGGGGSEVQLVESGGGLVQPGGSLKLSCAASGFTFNKYAMNWVRQAPGKGLEWVARIRSK YNNYATYYADSVKDRFTISRDDSKNTAYLQMNNLKTEDTAVYYCVRHGNFGNSYISYWAYWG QGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVF GGGTKLTVL |
| 510 | DLL3-14-017 xI2C | bispecific molecule | QVQLVQSGAEVKKPGASVKVSCKASGYTFTNYYMHWVRQAPGLCLEWMGIINPSDGSTSYAQ KFQGRVTMTRDTSTNTVYMDLSSLRSEDTAVYYCARGGNSAFYSYYDMDVWGQGTTVTVSSG GGGSGGGGSGGGGSDVVMTQTPLSLPVTLGQPASISCRSSQSLVYRDGNTYLSWFQQRPGQS PRRLIYKVSNWQSGVPDRFSGGGSGTDFTLKISRVEAEDVGVYYCMQGTHWPPTFGCGTKVE IKSGGGGSEVQLVESGGGLVQPGGSLKLSCAASGFTFNKYAMNWVRQAPGKGLEWVARIRSK YNNYATYYADSVKDRFTISRDDSKNTAYLQMNNLKTEDTAVYYCVRHGNFGNSYISYWAYWG QGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVF GGGTKLTVL |
| 511 | DLL3-14-018 xI2C | bispecific molecule | QVQLVQSGAEVKKPGASVKVSCKASGYTFTNYYMHWVRQAPGCLEWMGIINPSDGSTSYAQ KFQGRVTMTRDTSTNTVYMDLSSLRSEDTAVYYCARGGNSAFYSYYDMDVWGQGTTVTVSSG GGGSGGGGSGGGGSDVVMTQTPLSLPVTLGQPASISCRSSQSLVYRDGNTYLSWFQQRPGQS PRRLIYKVSNWQSGVPDRFSGGGSGTDFTLKISRVEAEDVGVYYCMQGTHWPPTFGCGTKVE IKSGGGGSEVQLVESGGGLVQPGGSLKLSCAASGFTFNKYAMNWVRQAPGKGLEWVARIRSK YNNYATYYADSVKDRFTISRDDSKNTAYLQMNNLKTEDTAVYYCVRHGNFGNSYISYWAYWG QGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVF GGGTKLTVL |
| 512 | DLL3-14-019 xI2C | bispecific molecule | QVQLVQSGAEVKKPGASVKVSCKASGYTFTNYYMHWVRQAPGLCLEWMGIINPSEGSTSYAQ KFQGRVTMTRDTSTNTVYMDLSSLRSEDTAVYYCARGGNSAFYSYYDMDVWGQGTTVTVSSG GGGSGGGGSGGGGSDVVMTQTPLSLPVTLGQPASISCRSSQSLVYRDGNTYLSWFQQRPGQS PRRLIYKVSNWQSGVPDRFSGGGSGTDFTLKISRVEAEDVGVYYCMQGTHWPPTFGCGTKVE IKSGGGGSEVQLVESGGGLVQPGGSLKLSCAASGFTFNKYAMNWVRQAPGKGLEWVARIRSK YNNYATYYADSVKDRFTISRDDSKNTAYLQMNNLKTEDTAVYYCVRHGNFGNSYISYWAYWG |

TABLE 18-continued

| SEQ ID NO | DLL3-epitope | Designation | Format / Source | Amino acid sequence |
|---|---|---|---|---|
| | | | | QGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVF GGGTKLTVL |
| 513 | | DLL3-14-020 xI2C | bispecific molecule | QVQLVQSGAEVKKPGASVKVSCKASGYTFTNYYMHWVRQAPGLCLEWMGIINPSDASTSYAQ KFQGRVTMTRDTSTNTVYMDLSSLRSEDTAVYYCARGGNSAFYSYYDMDVWGQGTTVTVSSG GGGSGGGGSGGGGSDVVMTQTPLSLPVTLGQPASISCRSSQSLVYRDGNTYLSWFQQRPGQS PRRLIYKVSNWQSGVPDRFSGGGSGTDFTLKISRVEAEDVGVYYCMQGTHWPPTFGCGTKVE IKSGGGGSEVQLVESGGGLVQPGGSLKLSCAASGFTFNKYAMNWVRQAPGKGLEWVARIRSK YNNYATYYADSVKDRFTISRDDSKNTAYLQMNNLKTEDTAVYYCVRHGNFGNSYISYWAYWG QGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVF GGGTKLTVL |
| 514 | | DLL3-14-021 xI2C | bispecific molecule | QVQLVQSGAEVKKPGASVKVSCKASGYTFTNYYMHWVRQAPGQCLEWMGIINPSDGSTSYAQ KFQGRVTMTRDTSTNTVYMDLSSLRSEDTAVYYCARGGNSAFYSYYDMDVWGQGTTVTVSSG GGGSGGGGSGGGGSDVVMTQTPLSLPVTLGQPASISCRSSQSLVYRDGNTYLSWFQQRPGQS PRRLIYKVSNWQSGVPDRFSGSGSGTDFTLKISRVEAEDVGVYYCMQGTHWPPTFGCGTKVE IKSGGGGSEVQLVESGGGLVQPGGSLKLSCAASGFTFNKYAMNWVRQAPGKGLEWVARIRSK YNNYATYYADSVKDRFTISRDDSKNTAYLQMNNLKTEDTAVYYCVRHGNFGNSYISYWAYWG QGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVF GGGTKLTVL |
| 515 | | DLL3-14-022 xI2C | bispecific molecule | QVQLVQSGAEVKKPGASVKVSCKASGYTFTNYYMHWVRQAPGQCLEWMGIINPSEGSTSYAQ KFQGRVTMTRDTSTNTVYMDLSSLRSEDTAVYYCARGGNSAFYSYYDMDVWGQGTTVTVSSG GGGSGGGGSGGGGSDVVMTQTPLSLPVTLGQPASISCRSSQSLVYREGNTYLSWFQQRPGQS PRRLIYKVSNWQSGVPDRFSGSGSGTDFTLKISRVEAEDVGVYYCMQGTHWPPTFGCGTKVE IKSGGGGSEVQLVESGGGLVQPGGSLKLSCAASGFTFNKYAMNWVRQAPGKGLEWVARIRSK YNNYATYYADSVKDRFTISRDDSKNTAYLQMNNLKTEDTAVYYCVRHGNFGNSYISYWAYWG QGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVF GGGTKLTVL |
| 516 | | DLL3-14-023 xI2C | bispecific molecule | QVQLVQSGAEVKKPGASVKVSCKASGYTFTNYYMHWVRQAPGQCLEWMGIINPSDASTSYAQ KFQGRVTMTRDTSTNTVYMDLSSLRSEDTAVYYCARGGNSAFYSYYDMDVWGQGTTVTVSSG GGGSGGGGSGGGGSDVVMTQTPLSLPVTLGQPASISCRSSQSLVYRDANTYLSWFQQRPGQS PRRLIYKVSNWQSGVPDRFSGSGSGTDFTLKISRVEAEDVGVYYCMQGTHWPPTFGCGTKVE IKSGGGGSEVQLVESGGGLVQPGGSLKLSCAASGFTFNKYAMNWVRQAPGKGLEWVARIRSK YNNYATYYADSVKDRFTISRDDSKNTAYLQMNNLKTEDTAVYYCVRHGNFGNSYISYWAYWG QGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVF GGGTKLTVL |
| 517 | | DLL3-4 xI2C - scFc | bispecific HLE molecule | QVQLQESGPGLVKPSETLSLTCTVSGGSISSYYWSWIRQPPGKGLEWIGYVYYSGTTNYNPS LKSRVTISVDTSKNQFSLKLSSVTAADTAVYYCASIAVTGFYFDYWGQGTLVTVSSGGGGSG GGGSGGGGSEIVLTQSPGTLSLSPGERVTLSCRASQRVNNNYLAWYQQRPGQAPRLLIYGAS SRATGIPDRFSGSGSGTDFTLTISRLEPEDFAVYYCQQYDRSPLTFGGGTKLEIKSGGGGSE VQLVESGGGLVQPGGSLKLSCAASGFTFNKYAMNWVRQAPGKGLEWVARIRSKYNNYATYYA DSVKDRFTISRDDSKNTAYLQMNNLKTEDTAVYYCVRHGNFGNSYISYWAYWGQGTLVTVSS GGGGSGGGGSGGGGSQTVVTQEPSLTVSPGGTVTLTCGSSTGAVTSGNYPNWVQQKPGQAPR GLIGGTKFLAPGTPARFSGSLLGGKAALTLSGVQPEDEAEYYCVLWYSNRWVFGGGTKLTVL GGGGDKTHTCPPCPAPELLGGPSVFLFPPKPKDTLMISRTPEVTCVVVDVSHEDPEVKFNWY VDGVEVHNAKTKPCEEQYGSTYRCVSVSLTVLHQDWLNGKEYKCKVSNKALPAPIEKTISKAK GQPREPQVYTLPPSREEMTKNQVSLTCLVKGFYPSDIAVEWESNGQPENNYKTTPPVLDSDG SFFLYSKLTVDKSRWQQGNVFSCSVMHEALHNHYTQKSLSLSPGKGGGGSGGGGSGGGGSGG GGSGGGGSGGGGSDKTHTCPPCPAPELLGGPSVFLFPPKPKDTLMISRTPEVTCVVVDVSHE DPEVKFNWYVDGVEVHNAKTKPCEEQYGSTYRCVSVLTVLHQDWLNGKEYKCKVSNKALPAP IEKTISKAKGQPREPQVYTLPPSREEMTKNQVSLTCLVKGFYPSDIAVEWESNGQPENNYKT TPPVLDSDGSFFLYSKLTVDKSRWQQGNVFSCSVMHEALHNHYTQKSLSLSPGK |
| 518 | | DLL3-4 xI2C - scFc_del GK | bispecific HLE molecule | QVQLQESGPGLVKPSETLSLTCTVSGGSISSYYWSWIRQPPGKGLEWIGYVYYSGTTNYNPS LKSRVTISVDTSKNQFSLKLSSVTAADTAVYYCASIAVTGFYFDYWGQGTLVTVSSGGGGSG GGGSGGGGSEIVLTQSPGTLSLSPGERVTLSCRASQRVNNNYLAWYQQRPGQAPRLLIYGAS SRATGIPDRFSGSGSGTDFTLTISRLEPEDFAVYYCQQYDRSPLTFGGGTKLEIKSGGGGSE VQLVESGGGLVQPGGSLKLSCAASGFTFNKYAMNWVRQAPGKGLEWVARIRSKYNNYATYYA DSVKDRFTISRDDSKNTAYLQMNNLKTEDTAVYYCVRHGNFGNSYISYWAYWGQGTLVTVSS GGGGSGGGGSGGGGSQTVVTQEPSLTVSPGGTVTLTCGSSTGAVTSGNYPNWVQQKPGQAPR GLIGGTKFLAPGTPARFSGSLLGGKAALTLSGVQPEDEAEYYCVLWYSNRWVFGGGTKLTVL GGGGDKTHTCPPCPAPELLGGPSVFLFPPKPKDTLMISRTPEVTCVVVDVSHEDPEVKFNWY VDGVEVHNAKTKPCEEQYGSTYRCVSVLTVLHQDWLNGKEYKCKVSNKALPAPIEKTISKAK GQPREPQVYTLPPSREEMTKNQVSLTCLVKGFYPSDIAVEWESNGQPENNYKTTPPVLDSDG SFFLYSKLTVDKSRWQQGNVFSCSVMHEALHNHYTQKSLSLSPGGGGSGGGGSGGGGSGGGG |

TABLE 18-continued

| SEQ ID NO | DLL3-epitope | Designation | Format / Source | Amino acid sequence |
|---|---|---|---|---|
| | | | | SGGGGSGGGGSDKTHTCPPCPAPELLGGPSVFLFPPKPKDTLMISRTPEVTCVVVDVSHEDP EVKFNWYVDGVEVHNAKTKPCEEQYGSTYRCVSVLTVLHQDWLNGKEYKCKVSNKALPAPIE KTISKAKGQPREPQVYTLPPSREEMTKNQVSLTCLVKGFYPSDIAVEWESNGQPENNYKTTP PVLDSDGSFFLYSKLTVDKSRWQQGNVFSCSVMHEALHNHYTQKSLSLSPGK |
| 519 | DLL3-4-001 (CC) xI2C - scFc | bispecific HLE molecule | QVQLQESGPGLVKPSETLSLTCTVSGGSISSYYWSWIRQPPGKCLEWIGYVYYSGTTNYNPS LKSRVTISVDTSKNQFSLKLSSVTAADTAVYYCASIAVTGFYFDYWGQGTLVTVSSGGGGS GGGSGGGGSEIVLTQSPGTLSLSPGERVTLSCRASQRVNNNYLAWYQQRPGQAPRLLIYGAS SRATGIPDRFSGSGSGTDFTLTISRLEPEDFAVYYCQQYDRSPLTFGCGTKLEIKSGGGGSE VQLVESGGGLVQPGGSLKLSCAASGFTFNKYAMNWVRQAPGKGLEWVARIRSKYNNYATYYA DSVKDRFTISRDDSKNTAYLQMNNLKTEDTAVYYCVRHGNFGNSYISYWAYWGQGTLVTVSS GGGGSGGGGSGGGGSQTVVTQEPSLTVSPGGTVTLTCGSSTGAVTSGNYPNWVQQKPGQAPR GLIGGTKFLAPGTPARFSGSLLGGKAALTLSGVQPEDEAEYYCVLWYSNRWVFGGGTKLTVL GGGGDKTHTCPPCPAPELLGGPSVFLFPPKPKDTLMISRTPEVTCVVVDVSHEDPEVKFNWY VDGVEVHNAKTKPCEEQYGSTYRCVSVLTVLHQDWLNGKEYKCKVSNKALPAPIEKTISKAK GQPREPQVYTLPPSREEMTKNQVSLTCLVKGFYPSDIAVEWESNGQPENNYKTTPPVLDSDG SFFLYSKLTVDKSRWQQGNVFSCSVMHEALHNHYTQKSLSLSPGKGGGGSGGGGSGGGGSGG GGSGGGGSGGGGSDKTHTCPPCPAPELLGGPSVFLFPPKPKDTLMISRTPEVTCVVVDVSHE DPEVKFNWYVDGVEVHNAKTKPCEEQYGSTYRCVSVLTVLHQDWLNGKEYKCKVSNKALPAP IEKTISKAKGQPREPQVYTLPPSREEMTKNQVSLTCLVKGFYPSDIAVEWESNGQPENNYKT TPPVLDSDGSFFLYSKLTVDKSRWQQGNVFSCSVMHEALHNHYTQKSLSLSPGK |
| 520 | DLL3-4-001 (CC) xI2C - scFc_delGK | bispecific hel molecule | QVQLQESGPGLVKPSETLSLTCTVSGGSISSYYWSWIRQPPGKCLEWIGYVYYSGTTNYNPS LKSRVTISVDTSKNQFSLKLSSVTAADTAVYYCASIAVTGFYFDYWGQGTLVTVSSGGGGS GGGSGGGGSEIVLTQSPGTLSLSPGERVTLSCRASQRVNNNYLAWYQQRPGQAPRLLIYGAS SRATGIPDRFSGSGSGTDFTLTISRLEPEDFAVYYCQQYDRSPLTFGCGTKLEIKSGGGGSE VQLVESGGGLVQPGGSLKLSCAASGFTFNKYAMNWVRQAPGKGLEWVARIRSKYNNYATYYA DSVKDRFTISRDDSKNTAYLQMNNLKTEDTAVYYCVRHGNFGNSYISYWAYWGQGTLVTVSS GGGGSGGGGSGGGGSQTVVTQEPSLTVSPGGTVTLTCGSSTGAVTSGNYPNWVQQKPGQAPR GLIGGTKFLAPGTPARFSGSLLGGKAALTLSGVQPEDEAEYYCVLWYSNRWVFGGGTKLTVL GGGGDKTHTCPPCPAPELLGGPSVFLFPPKPKDTLMISRTPEVTCVVVDVSHEDPEVKFNWY VDGVEVHNAKTKPCEEQYGSTYRCVSVLTVLHQDWLNGKEYKCKVSNKALPAPIEKTISKAK GQPREPQVYTLPPSREEMTKNQVSLTCLVKGFYPSDIAVEWESNGQPENNYKTTPPVLDSDG SFFLYSKLTVDKSRWQQGNVFSCSVMHEALHNHYTQKSLSLSPGGGGSGGGGSGGGGSGGGG SGGGGSGGGGSDKTHTCPPCPAPELLGGPSVFLFPPKPKDTLMISRTPEVTCVVVDVSHEDP EVKFNWYVDGVEVHNAKTKPCEEQYGSTYRCVSVLTVLHQDWLNGKEYKCKVSNKALPAPIE KTISKAKGQPREPQVYTLPPSREEMTKNQVSLTCLVKGFYPSDIAVEWESNGQPENNYKTTP PVLDSDGSFFLYSKLTVDKSRWQQGNVFSCSVMHEALHNHYTQKSLSLSPGK |
| 521 | DLL3-6 xI2C - scFc | bispecific HLE molecule | QVQLQESGPGLVKPSETLSLTCTVSGASISSFYWSWIRQPPGKGLEWIGYIYYSGTTNYNPS LKSRVTISVDTSKNQFSLKLSSVTAADTAVYYCARIAVAGFFFDYWGQGTLVTVSSGGGGS GGGSGGGGSEIVLTQSPGTLSLSPGERATLSCRASQSVNKNYLAWYQQKPGQAPRLLIYGAS SRATGIPDRFSGSGSGTDFTLTISRLEPEDFAVYYCQQYDRSPLTFGGGTKVEIKSGGGGSE VQLVESGGGLVQPGGSLKLSCAASGFTFNKYAMNWVRQAPGKGLEWVARIRSKYNNYATYYA DSVKDRFTISRDDSKNTAYLQMNNLKTEDTAVYYCVRHGNFGNSYISYWAYWGQGTLVTVSS GGGGSGGGGSGGGGSQTVVTQEPSLTVSPGGTVTLTCGSSTGAVTSGNYPNWVQQKPGQAPR GLIGGTKFLAPGTPARFSGSLLGGKAALTLSGVQPEDEAEYYCVLWYSNRWVFGGGTKLTVL GGGGDKTHTCPPCPAPELLGGPSVFLFPPKPKDTLMISRTPEVTCVVVDVSHEDPEVKFNWY VDGVEVHNAKTKPCEEQYGSTYRCVSVLTVLHQDWLNGKEYKCKVSNKALPAPIEKTISKAK GQPREPQVYTLPPSREEMTKNQVSLTCLVKGFYPSDIAVEWESNGQPENNYKTTPPVLDSDG SFFLYSKLTVDKSRWQQGNVFSCSVMHEALHNHYTQKSLSLSPGKGGGGSGGGGSGGGGSGG GGSGGGGSGGGGSDKTHTCPPCPAPELLGGPSVFLFPPKPKDTLMISRTPEVTCVVVDVSHE DPEVKFNWYVDGVEVHNAKTKPCEEQYGSTYRCVSVLTVLHQDWLNGKEYKCKVSNKALPAP IEKTISKAKGQPREPQVYTLPPSREEMTKNQVSLTCLVKGFYPSDIAVEWESNGQPENNYKT TPPVLDSDGSFFLYSKLTVDKSRWQQGNVFSCSVMHEALHNHYTQKSLSLSPGK |
| 522 | DLL3-6 xI2C - scFc_delGK | bispecific HLE molecule | QVQLQESGPGLVKPSETLSLTCTVSGASISSFYWSWIRQPPGKGLEWIGYIYYSGTTNYNPS LKSRVTISVDTSKNQFSLKLSSVTAADTAVYYCARIAVAGFFFDYWGQGTLVTVSSGGGGS GGGSGGGGSEIVLTQSPGTLSLSPGERATLSCRASQSVNKNYLAWYQQKPGQAPRLLIYGAS SRATGIPDRFSGSGSGTDFTLTISRLEPEDFAVYYCQQYDRSPLTFGGGTKVEIKSGGGGSE VQLVESGGGLVQPGGSLKLSCAASGFTFNKYAMNWVRQAPGKGLEWVARIRSKYNNYATYYA DSVKDRFTISRDDSKNTAYLQMNNLKTEDTAVYYCVRHGNFGNSYISYWAYWGQGTLVTVSS GGGGSGGGGSGGGGSQTVVTQEPSLTVSPGGTVTLTCGSSTGAVTSGNYPNWVQQKPGQAPR GLIGGTKFLAPGTPARFSGSLLGGKAALTLSGVQPEDEAEYYCVLWYSNRWVFGGGTKLTVL GGGGDKTHTCPPCPAPELLGGPSVFLFPPKPKDTLMISRTPEVTCVVVDVSHEDPEVKFNWY VDGVEVHNAKTKPCEEQYGSTYRCVSVLTVLHQDWLNGKEYKCKVSNKALPAPIEKTISKAK GQPREPQVYTLPPSREEMTKNQVSLTCLVKGFYPSDIAVEWESNGQPENNYKTTPPVLDSDG SFFLYSKLTVDKSRWQQGNVFSCSVMHEALHNHYTQKSLSLSPGGGGSGGGGSGGGGSGGGG SGGGGSGGGGSDKTHTCPPCPAPELLGGPSVFLFPPKPKDTLMISRTPEVTCVVVDVSHEDP EVKFNWYVDGVEVHNAKTKPCEEQYGSTYRCVSVLTVLHQDWLNGKEYKCKVSNKALPAPIE KTISKAKGQPREPQVYTLPPSREEMTKNQVSLTCLVKGFYPSDIAVEWESNGQPENNYKTTP PVLDSDGSFFLYSKLTVDKSRWQQGNVFSCSVMHEALHNHYTQKSLSLSPGK |
| 523 | DLL3-6-001 (CC) xI2C - | bispecific HLE molecule | QVQLQESGPGLVKPSETLSLTCTVSGASISSFYWSWIRQPPGKCLEWIGYIYYSGTTNYNPS LKSRVTISVDTSKNQFSLKLSSVTAADTAVYYCARIAVAGFFFDYWGQGTLVTVSSGGGGS GGGSGGGGSEIVLTQSPGTLSLSPGERATLSCRASQSVNKNYLAWYQQKPGQAPRLLIYGAS |

TABLE 18-continued

| SEQ ID NO | DLL3-epitope | Designation | Format / Source | Amino acid sequence |
|---|---|---|---|---|
| | | | scFc | SRATGIPDRFSGSGSGTDFTLTISRLEPEDFAVYYCQQYDRSPLTFGCGTKVEIKSGGGGSE VQLVESGGGLVQPGGSLKLSCAASGFTFNKYAMNWVRQAPGKGLEWVARIRSKYNNYATYYA DSVKDRFTISRDDSKNTAYLQMNNLKTEDTAVYYCVRHGNFGNSYISYWAYWGQGTLVTVSS GGGGSGGGGSGGGGSQTVVTQEPSLTVSPGGTVTLTCGSSTGAVTSGNYPNWVQQKPGQAPR GLIGGTKFLAPGTPARFSGSLLGGKAALTLSGVQPEDEAEYYCVLWYSNRWVFGGGTKLTVL GGGGDKTHTCPPCPAPELLGGPSVFLFPPKPKDTLMISRTPEVTCVVVDVSHEDPEVKFNWY VDGVEVHNAKTKPCEEQYGSTYRCVSVLTVLHQDWLNGKEYKCKVSNKALPAPIEKTISKAK GQPREPQVYTLPPSREEMTKNQVSLTCLVKGFYPSDIAVEWESNGQPENNYKTTPPVLDSDG SFFLYSKLTVDKSRWQQGNVFSCSVMHEALHNHYTQKSLSLSPGKGGGGSGGGGSGGGGSGG GGSGGGGSGGGGSDKTHTCPPCPAPELLGGPSVFLFPPKPKDTLMISRTPEVTCVVVDVSHE DPEVKFNWYVDGVEVHNAKTKPCEEQYGSTYRCVSVLTVLHQDWLNGKEYKCKVSNKALPAP IEKTISKAKGQPREPQVYTLPPSREEMTKNQVSLTCLVKGFYPSDIAVEWESNGQPENNYKT TPPVLDSDGSFFLYSKLTVDKSRWQQGNVFSCSVMHEALHNHYTQKSLSLSPGK |
| 524 | | DLL3-6-001 CC xI2C - scFc_del GK | bispecific HLE molecule | QVQLQESGPGLVKPSETLSLTCTVSGASISSFYWSWIRQPPGKCLEWIGYIYYSGTTNYNPS LKSRVTISVDTSKNQFSLKLSSVTAADTAVYYCARIAVAGFFFDYWGQGTLVTVSSGGGGSG GGGSGGGGSEIVLTQSPGTLSLSPGERATLSCRASQSVNKNYLAWYQQKPGQAPRLLIYGAS SRATGIPDRFSGSGSGTDFTLTISRLEPEDFAVYYCQQYDRSPLTFGCGTKVEIKSGGGGSE VQLVESGGGLVQPGGSLKLSCAASGFTFNKYAMNWVRQAPGKGLEWVARIRSKYNNYATYYA DSVKDRFTISRDDSKNTAYLQMNNLKTEDTAVYYCVRHGNFGNSYISYWAYWGQGTLVTVSS GGGGSGGGGSGGGGSQTVVTQEPSLTVSPGGTVTLTCGSSTGAVTSGNYPNWVQQKPGQAPR GLIGGTKFLAPGTPARFSGSLLGGKAALTLSGVQPEDEAEYYCVLWYSNRWVFGGGTKLTVL GGGGDKTHTCPPCPAPELLGGPSVFLFPPKPKDTLMISRTPEVTCVVVDVSHEDPEVKFNWY VDGVEVHNAKTKPCEEQYGSTYRCVSVLTVLHQDWLNGKEYKCKVSNKALPAPIEKTISKAK GQPREPQVYTLPPSREEMTKNQVSLTCLVKGFYPSDIAVEWESNGQPENNYKTTPPVLDSDG SFFLYSKLTVDKSRWQQGNVFSCSVMHEALHNHYTQKSLSLSPGGGGSGGGGSGGGGSGGGG SGGGGSGGGGSDKTHTCPPCPAPELLGGPSVFLFPPKPKDTLMISRTPEVTCVVVDVSHEDP EVKFNWYVDGVEVHNAKTKPCEEQYGSTYRCVSVLTVLHQDWLNGKEYKCKVSNKALPAPIE KTISKAKGQPREPQVYTLPPSREEMTKNQVSLTCLVKGFYPSDIAVEWESNGQPENNYKTTP PVLDSDGSFFLYSKLTVDKSRWQQGNVFSCSVMHEALHNHYTQKSLSLSPGK |
| 525 | | DLL3-14 xI2C - scFc | bispecific HLE molecule | QVQLVQSGAEVKKPGASVKVSCKASGYTFTNYYMHWVRQAPGLGLEWMGIINPSDGSTSYAQ KFQGRVTMTRDTSTNTVYMDLSSLRSEDTAVYYCARGGNSAFYSYYDMDVWGQGTTVTVSSG GGGSGGGGSGGGGSDVVMTQTPLSLPVTLGQPASISCRSSQSLVYRDGNTYLSWFQQRPGQS PRRLIYKVSNWQSGVPDRFSGGGSGTDFTLKISRVEAEDVGVYYCMQGTHWPPTFGQGTKVE IKSGGGGSEVQLVESGGGLVQPGGSLKLSCAASGFTFNKYAMNWVRQAPGKGLEWVARIRSK YNNYATYYADSVKDRFTISRDDSKNTAYLQMNNLKTEDTAVYYCVRHGNFGNSYISYWAYWG QGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVF GGGTKLTVLGGGGDKTHTCPPCPAPELLGGPSVFLFPPKPKDTLMISRTPEVTCVVVDVSHE DPEVKFNWYVDGVEVHNAKTKPCEEQYGSTYRCVSVLTVLHQDWLNGKEYKCKVSNKALPAP IEKTISKAKGQPREPQVYTLPPSREEMTKNQVSLTCLVKGFYPSDIAVEWESNGQPENNYKT TPPVLDSDGSFFLYSKLTVDKSRWQQGNVFSCSVMHEALHNHYTQKSLSLSPGKGGGGSGGG GSGGGGSGGGGSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLTVLHQDWLNGKEYKCK VSNKALPAPIEKTISKAKGQPREPQVYTLPPSREEMTKNQVSLTCLVKGFYPSDIAVEWESN GQPENNYKTTPPVLDSDGSFFLYSKLTVDKSRWQQGNVFSCSVMHEALHNHYTQKSLSLSPG K |
| 526 | | DLL3-14 xI2C - scFc_del GK | bispecific HLE molecule | QVQLVQSGAEVKKPGASVKVSCKASGYTFTNYYMHWVRQAPGLGLEWMGIINPSDGSTSYAQ KFQGRVTMTRDTSTNTVYMDLSSLRSEDTAVYYCARGGNSAFYSYYDMDVWGQGTTVTVSSG GGGSGGGGSGGGGSDVVMTQTPLSLPVTLGQPASISCRSSQSLVYRDGNTYLSWFQQRPGQS PRRLIYKVSNWQSGVPDRFSGGGSGTDFTLKISRVEAEDVGVYYCMQGTHWPPTFGQGTKVE IKSGGGGSEVQLVESGGGLVQPGGSLKLSCAASGFTFNKYAMNWVRQAPGKGLEWVARIRSK YNNYATYYADSVKDRFTISRDDSKNTAYLQMNNLKTEDTAVYYCVRHGNFGNSYISYWAYWG QGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVF GGGTKLTVLGGGGDKTHTCPPCPAPELLGGPSVFLFPPKPKDTLMISRTPEVTCVVVDVSHE DPEVKFNWYVDGVEVHNAKTKPCEEQYGSTYRCVSVLTVLHQDWLNGKEYKCKVSNKALPAP IEKTISKAKGQPREPQVYTLPPSREEMTKNQVSLTCLVKGFYPSDIAVEWESNGQPENNYKT TPPVLDSDGSFFLYSKLTVDKSRWQQGNVFSCSVMHEALHNHYTQKSLSLSPGGGGSGGGGS GGGGSGGGGSGGGGSGGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVLHQDWLNGKEYKCKVS NKALPAPIEKTISKAKGQPREPQVYTLPPSREEMTKNQVSLTCLVKGFYPSDIAVEWESNGQ PENNYKTTPPVLDSDGSFFLYSKLTVDKSRWQQGNVFSCSVMHEALHNHYTQKSLSLSPGK |
| 527 | | DLL3-14-012 (CC) xI2C - scFc | bispecific HLE molecule | QVQLVQSGAEVKKPGASVKVSCKASGYTFTNYYMHWVRQAPGLCLEWMGIINPSDGSTSYAQ KFQGRVTMTRDTSTNTVYMDLSSLRSEDTAVYYCARGGNSAFYSYYDMDVWGQGTTVTVSSG GGGSGGGGSGGGGSDVVMTQTPLSLPVTLGQPASISCRSSQSLVYRDGNTYLSWFQQRPGQS PRRLIYKVSNWQSGVPDRFSGGGSGTDFTLKISRVEAEDVGVYYCMQGTHWPPTFGCGTKVE IKSGGGGSEVQLVESGGGLVQPGGSLKLSCAASGFTFNKYAMNWVRQAPGKGLEWVARIRSK YNNYATYYADSVKDRFTISRDDSKNTAYLQMNNLKTEDTAVYYCVRHGNFGNSYISYWAYWG QGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVF GGGTKLTVLGGGGDKTHTCPPCPAPELLGGPSVFLFPPKPKDTLMISRTPEVTCVVVDVSHE DPEVKFNWYVDGVEVHNAKTKPCEEQYGSTYRCVSVLTVLHQDWLNGKEYKCKVSNKALPAP |

TABLE 18-continued

| SEQ ID NO | DLL3-epitope | Designation | Format / Source | Amino acid sequence |
|---|---|---|---|---|
| | | | | IEKTISKAKGQPREPQVYTLPPSREEMTKNQVSLTCLVKGFYPSDIAVEWESNGQPENNYKT TPPVLDSDGSFFLYSKLTVDKSRWQQGNVFSCSVMHEALHNHYTQKSLSLSPGKGGGGSGGGG GSGGGGSGGGGSGGGGSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLTVLHQDWLNGKEYKCK VSNKALPAPIEKTISKAKGQPREPQVYTLPPSREEMTKNQVSLTCLVKGFYPSDIAVEWESN GQPENNYKTTPPVLDSDGSFFLYSKLTVDKSRWQQGNVFSCSVMHEALHNHYTQKSLSLSPG K |
| 528 | DLL3-14-012 CC xI2C-scFc_del GK | bispecific HLE molecule | | QVQLVQSGAEVKKPGASVKVSCKASGYTFTNYYMHWVRQAPGLCLEWMGIINPDGSTSYAQ KFQGRVTMTRDTSTNTVYMDLSSLRSEDTAVYYCARGGNSAFYSYYDMDVWGQGTTVTVSSG GGGSGGGGSGGGGSDVVMTQTPLSLPVTLGQPASISCRSSQSLVYRDGNTYLSWFQQRPGQS PRRLIYKVSNWQSGVPDRFSGGGSGTDFTLKISRVEAEDVGVYYCMQGTHWPPTFGCGTKVE IKSGGGGSEVQLVESGGGLVQPGGSLKLSCAASGFTFNKYAMNWVRQAPGKGLEWVARIRSK YNNYATYYADSVKDRFTISRDDSKNTAYLQMNNLKTEDTAVYYCVRHGNFGNSYISYWAYWG QGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVF GGGTKLTVLGGGGDKTHTCPPCPAPELLGGPSVFLFPPKPKDTLMISRTPEVTCVVVDVSHE DPEVKFNWYVDGVEVHNAKTKPCEEQYGSTYRCVSVLTVLHQDWLNGKEYKCKVSNKALPAP IEKTISKAKGQPREPQVYTLPPSREEMTKNQVSLTCLVKGFYPSDIAVEWESNGQPENNYKT TPPVLDSDGSFFLYSKLTVDKSRWQQGNVFSCSVMHEALHNHYTQKSLSLSPGGGGSGGGGS GGGGSGGGGSGGGGSGGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVLHQDWLNGKEYKCKVS NKALPAPIEKTISKAKGQPREPQVYTLPPSREEMTKNQVSLTCLVKGFYPSDIAVEWESNGQ PENNYKTTPPVLDSDGSFFLYSKLTVDKSRWQQGNVFSCSVMHEALHNHYTQKSLSLSPGK |
| 529 | DLL3-6-001 (CC) | VH | | QVQLQESGPGLVKPSETLSLTCTVSGASISSFYWSWIRQPPGKCLEWIGYIYYSGTTNYNPS LKSRVTISVDTSKNQFSLKLSSVTAADTAVYYCARIAVAGFFFDWGQGTLVTVSS |
| 530 | DLL3-6-001 (CC) | VL | | EIVLTQSPGTLSLSPGERATLSCRASQSVNKNYLAWYQQKPGQAPRLLIYGASSRATGIPDR FSGSGSGTDFTLTISRLEPEDFAVYYCQQYDRSPLTFGCGTKVEIK |
| 531 | DLL3-6-001 (CC) | scFv | | QVQLQESGPGLVKPSETLSLTCTVSGASISSFYWSWIRQPPGKCLEWIGYIYYSGTTNYNPS LKSRVTISVDTSKNQFSLKLSSVTAADTAVYYCARIAVAGFFFDWGQGTLVTVSSGGGGSG GGGSGGGGSEIVLTQSPGTLSLSPGERATLSCRASQSVNKNYLAWYQQKPGQAPRLLIYGAS SRATGIPDRFSGSGSGTDFTLTISRLEPEDFAVYYCQQYDRSPLTFGCGTKVEIK |
| 532 | DLL3-6-001 (CC) xI2C | bispecific molecule | | QVQLQESGPGLVKPSETLSLTCTVSGASISSFYWSWIRQPPGKCLEWIGYIYYSGTTNYNPS LKSRVTISVDTSKNQFSLKLSSVTAADTAVYYCARIAVAGFFFDWGQGTLVTVSSGGGGSG GGGSGGGGSEIVLTQSPGTLSLSPGERATLSCRASQSVNKNYLAWYQQKPGQAPRLLIYGAS SRATGIPDRFSGSGSGTDFTLTISRLEPEDFAVYYCQQYDRSPLTFGCGTKVEIKSGGGGSE VQLVESGGGLVQPGGSLKLSCAASGFTFNKYAMNWVRQAPGKGLEWVARIRSKYNNYATYYA DSVKDRFTISRDDSKNTAYLQMNNLKTEDTAVYYCVRHGNFGNSYISYWAYWGQGTLVTVSS GGGGSGGGGSGGGGSQTVVTQEPSLTVSPGGTVTLTCGSSTGAVTSGNYPNWVQQKPGQAPR GLIGGTKFLAPGTPARFSGSLLGGKAALTLSGVQPEDEAEYYCVLWYSNRWVFGGGTKLTVL |
| 533 | Fc monomer-1 +c/-g | | | DKTHTCPPCPAPELLGGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALPAPIEKTISKAKGQPR EPQVYTLPPSREEMTKNQVSLTCLVKGFYPSDIAVEWESNGQPENNYKTTPPVLDSDGSFFL YSKLTVDKSRWQQGNVFSCSVMHEALHNHYTQKSLSLSPGK |
| 534 | Fc monomer-2 +c/-g/ delGK | | | DKTHTCPPCPAPELLGGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALPAPIEKTISKAKGQPR EPQVYTLPPSREEMTKNQVSLTCLVKGFYPSDIAVEWESNGQPENNYKTTPPVLDSDGSFFL YSKLTVDKSRWQQGNVFSCSVMHEALHNHYTQKSLSLSP |
| 535 | Fc monomer-3 -c/+g | | | DKTHTCPPCPAPELLGGPSVFLFPPKPKDTLMISRTPEVTCVVVDVSHEDPEVKFNWYVDGV EVHNAKTKPREEQYNSTYRVVSVLTVLHQDWLNGKEYKCKVSNKALPAPIEKTISKAKGQPR EPQVYTLPPSREEMTKNQVSLTCLVKGFYPSDIAVEWESNGQPENNYKTTPPVLDSDGSFFL YSKLTVDKSRWQQGNVFSCSVMHEALHNHYTQKSLSLSPGK |
| 536 | Fc monomer-4 -c/-g/ delGK | | | DKTHTCPPCPAPELLGGPSVFLFPPKPKDTLMISRTPEVTCVVVDVSHEDPEVKFNWYVDGV EVHNAKTKPREEQYNSTYRVVSVLTVLHQDWLNGKEYKCKVSNKALPAPIEKTISKAKGQPR EPQVYTLPPSREEMTKNQVSLTCLVKGFYPSDIAVEWESNGQPENNYKTTPPVLDSDGSFFL YSKLTVDKSRWQQGNVFSCSVMHEALHNHYTQKSLSLSP |
| 537 | Fc monomer-5 -c/-g | | | DKTHTCPPCPAPELLGGPSVFLFPPKPKDTLMISRTPEVTCVVVDVSHEDPEVKFNWYVDGV EVHNAKTKPREEQYGSTYRVVSVLTVLHQDWLNGKEYKCKVSNKALPAPIEKTISKAKGQPR EPQVYTLPPSREEMTKNQVSLTCLVKGFYPSDIAVEWESNGQPENNYKTTPPVLDSDGSFFL YSKLTVDKSRWQQGNVFSCSVMHEALHNHYTQKSLSLSPGK |

TABLE 18-continued

| SEQ ID NO | DLL3-epitope | Designation | Format / Source | Amino acid sequence |
|---|---|---|---|---|
| 538 | | Fc monomer-6 -c/-g/ delGK | | DKTHTCPPCPAPELLGGPSVFLFPPKPKDTLMISRTPEVTCVVVDVSHEDPEVKFNWYVDGV EVHNAKTKPREEQYGSTYRVVSVLTVLHQDWLNGKEYKCKVSNKALPAPIEKTISKAKGQPR EPQVYTLPPSREEMTKNQVSLTCLVKGFYPSDIAVEWESNGQPENNYKTTPPVLDSDGSFFL YSKLTVDKSRWQQGNVFSCSVMHEALHNHYTQKSLSLSP |
| 539 | | Fc monomer-7 +c/+g | | DKTHTCPPCPAPELLGGPSVFLFPPKPKDTLMISRTPEVTCVVVDVSHEDPEVKFNWYVDGV EVHNAKTKPCEEQYNSTYRCVSVLTVLHQDWLNGKEYKCKVSNKALPAPIEKTISKAKGQPR EPQVYTLPPSREEMTKNQVSLTCLVKGFYPSDIAVEWESNGQPENNYKTTPPVLDSDGSFFL YSKLTVDKSRWQQGNVFSCSVMHEALHNHYTQKSLSLSPGK |
| 540 | | Fc monomer-8 +c/+g/ delGK | | DKTHTCPPCPAPELLGGPSVFLFPPKPKDTLMISRTPEVTCVVVDVSHEDPEVKFNWYVDGV EVHNAKTKPCEEQYNSTYRCVSVLTVLHQDWLNGKEYKCKVSNKALPAPIEKTISKAKGQPR EPQVYTLPPSREEMTKNQVSLTCLVKGFYPSDIAVEWESNGQPENNYKTTPPVLDSDGSFFL YSKLTVDKSRWQQGNVFSCSVMHEALHNHYTQKSLSLSP |
| 541 | | scFc-1 | | DKTHTCPPCPAPELLGGPSVFLFPPKPKDTLMISRTPEVTCVVVDVSHEDPEVKFNWYVDGV EVHNAKTKPCEEQYNSTYRCVSVLTVLHQDWLNGKEYKCKVSNKALPAPIEKTISKAKGQPR EPQVYTLPPSREEMTKNQVSLTCLVKGFYPSDIAVEWESNGQPENNYKTTPPVLDSDGSFFL YSKLTVDKSRWQQGNVFSCSVMHEALHNHYTQKSLSLSPGKGGGGSGGGGSGGGGSGGGGSG GGGSGGGGSDKTHTCPPCPAPELLGGPSVFLFPPKPKDTLMISRTPEVTCVVVDVSHEDPEV KFNWYVDGVEVHNAKTKPCEEQYNSTYRCVSVLTVLHQDWLNGKEYKCKVSNKALPAPIEKT ISKAKGQPREPQVYTLPPSREEMTKNQVSLTCLVKGFYPSDIAVEWESNGQPENNYKTTPPV LDSDGSFFLYSKLTVDKSRWQQGNVFSCSVMHEALHNHYTQKSLSLSPGK |
| 542 | | scFc-2 | | DKTHTCPPCPAPELLGGPSVFLFPPKPKDTLMISRTPEVTCVVVDVSHEDPEVKFNWYVDGV EVHNAKTKPCEEQYNSTYRCVSVLTVLHQDWLNGKEYKCKVSNKALPAPIEKTISKAKGQPR EPQVYTLPPSREEMTKNQVSLTCLVKGFYPSDIAVEWESNGQPENNYKTTPPVLDSDGSFFL YSKLTVDKSRWQQGNVFSCSVMHEALHNHYTQKSLSLSPGGGGSGGGGSGGGGSGGGGSGGG GSGGGGSDKTHTCPPCPAPELLGGPSVFLFPPKPKDTLMISRTPEVTCVVVDVSHEDPEVKF NWYVDGVEVHNAKTKPCEEQYNSTYRCVSVLTVLHQDWLNGKEYKCKVSNKALPAPIEKTIS KAKGQPREPQVYTLPPSREEMTKNQVSLTCLVKGFYPSDIAVEWESNGQPENNYKTTPPVLD SDGSFFLYSKLTVDKSRWQQGNVFSCSVMHEALHNHYTQKSLSLSP |
| 543 | | scFc-3 | | DKTHTCPPCPAPELLGGPSVFLFPPKPKDTLMISRTPEVTCVVVDVSHEDPEVKFNWYVDGV EVHNAKTKPREEQYNSTYRVVSVLTVLHQDWLNGKEYKCKVSNKALPAPIEKTISKAKGQPR EPQVYTLPPSREEMTKNQVSLTCLVKGFYPSDIAVEWESNGQPENNYKTTPPVLDSDGSFFL YSKLTVDKSRWQQGNVFSCSVMHEALHNHYTQKSLSLSPGKGGGGSGGGGSGGGGSGGGGSG GGGSGGGGSDKTHTCPPCPAPELLGGPSVFLFPPKPKDTLMISRTPEVTCVVVDVSHEDPEV KFNWYVDGVEVHNAKTKPREEQYNSTYRVVSVLTVLHQDWLNGKEYKCKVSNKALPAPIEKT ISKAKGQPREPQVYTLPPSREEMTKNQVSLTCLVKGFYPSDIAVEWESNGQPENNYKTTPPV LDSDGSFFLYSKLTVDKSRWQQGNVFSCSVMHEALHNHYTQKSLSLSPGK |
| 544 | | scFc-4 | | DKTHTCPPCPAPELLGGPSVFLFPPKPKDTLMISRTPEVTCVVVDVSHEDPEVKFNWYVDGV EVHNAKTKPREEQYNSTYRVVSVLTVLHQDWLNGKEYKCKVSNKALPAPIEKTISKAKGQPR EPQVYTLPPSREEMTKNQVSLTCLVKGFYPSDIAVEWESNGQPENNYKTTPPVLDSDGSFFL YSKLTVDKSRWQQGNVFSCSVMHEALHNHYTQKSLSLSPGGGGSGGGGSGGGGSGGGGSGGG GSGGGGSDKTHTCPPCPAPELLGGPSVFLFPPKPKDTLMISRTPEVTCVVVDVSHEDPEVKF NWYVDGVEVHNAKTKPREEQYNSTYRVVSVLTVLHQDWLNGKEYKCKVSNKALPAPIEKTIS KAKGQPREPQVYTLPPSREEMTKNQVSLTCLVKGFYPSDIAVEWESNGQPENNYKTTPPVLD SDGSFFLYSKLTVDKSRWQQGNVFSCSVMHEALHNHYTQKSLSLSP |
| 545 | | scFc-5 | | DKTHTCPPCPAPELLGGPSVFLFPPKPKDTLMISRTPEVTCVVVDVSHEDPEVKFNWYVDGV EVHNAKTKPREEQYGSTYRVVSVLTVLHQDWLNGKEYKCKVSNKALPAPIEKTISKAKGQPR EPQVYTLPPSREEMTKNQVSLTCLVKGFYPSDIAVEWESNGQPENNYKTTPPVLDSDGSFFL YSKLTVDKSRWQQGNVFSCSVMHEALHNHYTQKSLSLSPGKGGGGSGGGGSGGGGSGGGGSG GGGSGGGGSDKTHTCPPCPAPELLGGPSVFLFPPKPKDTLMISRTPEVTCVVVDVSHEDPEV KFNWYVDGVEVHNAKTKPREEQYGSTYRVVSVLTVLHQDWLNGKEYKCKVSNKALPAPIEKT ISKAKGQPREPQVYTLPPSREEMTKNQVSLTCLVKGFYPSDIAVEWESNGQPENNYKTTPPV LDSDGSFFLYSKLTVDKSRWQQGNVFSCSVMHEALHNHYTQKSLSLSPGK |
| 546 | | scFc-6 | | DKTHTCPPCPAPELLGGPSVFLFPPKPKDTLMISRTPEVTCVVVDVSHEDPEVKFNWYVDGV EVHNAKTKPREEQYGSTYRVVSVLTVLHQDWLNGKEYKCKVSNKALPAPIEKTISKAKGQPR EPQVYTLPPSREEMTKNQVSLTCLVKGFYPSDIAVEWESNGQPENNYKTTPPVLDSDGSFFL YSKLTVDKSRWQQGNVFSCSVMHEALHNHYTQKSLSLSPGGGGSGGGGSGGGGSGGGGSGGG GSGGGGSDKTHTCPPCPAPELLGGPSVFLFPPKPKDTLMISRTPEVTCVVVDVSHEDPEVKF NWYVDGVEVHNAKTKPREEQYGSTYRVVSVLTVLHQDWLNGKEYKCKVSNKALPAPIEKTIS KAKGQPREPQVYTLPPSREEMTKNQVSLTCLVKGFYPSDIAVEWESNGQPENNYKTTPPVLD SDGSFFLYSKLTVDKSRWQQGNVFSCSVMHEALHNHYTQKSLSLSP |
| 547 | | scFc-7 | | DKTHTCPPCPAPELLGGPSVFLFPPKPKDTLMISRTPEVTCVVVDVSHEDPEVKFNWYVDGV EVHNAKTKPCEEQYNSTYRCVSVLTVLHQDWLNGKEYKCKVSNKALPAPIEKTISKAKGQPR EPQVYTLPPSREEMTKNQVSLTCLVKGFYPSDIAVEWESNGQPENNYKTTPPVLDSDGSFFL YSKLTVDKSRWQQGNVFSCSVMHEALHNHYTQKSLSLSPGKGGGGSGGGGSGGGGSGGGGSG GGGSGGGGSDKTHTCPPCPAPELLGGPSVFLFPPKPKDTLMISRTPEVTCVVVDVSHEDPEV |

TABLE 18-continued

| SEQ ID NO | DLL3-epitope | Designation | Format / Source | Amino acid sequence |
|---|---|---|---|---|
| | | | | KFNWYVDGVEVHNAKTKPCEEQYNSTYRCVSVLTVLHQDWLNGKEYKCKVSNKALPAPIEKT ISKAKGQPREPQVYTLPPSREEMTKNQVSLTCLVKGFYPSDIAVEWESNGQPENNYKTTPPV LDSDGSFFLYSKLTVDKSRWQQGNVFSCSVMHEALHNHYTQKSLSLSPGK |
| 548 | | scFc-8 | | DKTHTCPPCPAPELLGGPSVFLFPPKPKDTLMISRTPEVTCVVVDVSHEDPEVKFNWYVDGV EVHNAKTKPCEEQYNSTYRCVSVLTVLHQDWLNGKEYKCKVSNKALPAPIEKTISKAKGQPR EPQVYTLPPSREEMTKNQVSLTCLVKGFYPSDIAVEWESNGQPENNYKTTPPVLDSDGSFFL YSKLTVDKSRWQQGNVFSCSVMHEALHNHYTQKSLSLSPGGGGSGGGGSGGGGSGGGGSGGG GSGGGGSDKTHTCPPCPAPELLGGPSVFLFPPKPKDTLMISRTPEVTCVVVDVSHEDPEVKF NWYVDGVEVHNAKTKPCEEQYNSTYRCVSVLTVLHQDWLNGKEYKCKVSNKALPAPIEKTIS KAKGQPREPQVYTLPPSREEMTKNQVSLTCLVKGFYPSDIAVEWESNGQPENNYKTTPPVLD SDGSFFLYSKLTVDKSRWQQGNVFSCSVMHEALHNHYTQKSLSLSP |
| 549 | | $(G_4S)_4$ linker | | GGGGSGGGGSGGGGSGGGGS |
| 550 | | $(G_4S)_5$ linker | | GGGGSGGGGSGGGGSGGGGSGGGGS |
| 551 | | $(G_4S)_6$ linker | | GGGGSGGGGSGGGGSGGGGSGGGGSGGGGS |
| 552 | | $(G_4S)_7$ linker | | GGGGSGGGGSGGGGSGGGGSGGGGSGGGGSGGGGS |
| 553 | | $(G_4S)_8$ linker | | GGGGSGGGGSGGGGSGGGGSGGGGSGGGGSGGGGSGGGGS |
| 554 | | DLL3-22 | bispecific molecule | QVQLQESGPGLVKPSETLSLTCTVSGDSISSYYWTWIRQPPGKGLEWIGYIYYSGTTNYNPS LKSRVTISVDTSKSQFSLKLSSVTAADTAVYYCASIAVRGFFFDYWGQGTLVTVSSGGGGSG GGGSGGGGSEIVLTQSPGTLSLSPGERATLSCRASQSVSSSYLAWYQQKPGQAPRLLIYGAS TRATGIPDRFSGSGSGTDFTLTISRLEPEDFAVYYCQQYGTSPLTFGGGTKVEIKRSGGGGS EVQLVESGGGLVQPGGSLKLSCAASGFTFNKYAMNWVRQAPGKGLEWVARIRSKYNNYATYY ADSVKDRFTISRDDSKNTAYLQMNNLKTEDTAVYYCVRHGNFGNSYISYWAYWGQGTLVTVS SGGGGSGGGGSGGGGSGGGSQTVVTQEPSLTVSPGGTVTLTCGSSTGAVTSGNYPNWVQQKPGQAP RGLIGGTKFLAPGTPARFSGSLLGGKAALTLSGVQPEDEAEYYCVLWYSNRWVFGGGTKLTV LHHHHHH |

SEQUENCE LISTING (554 sequences)

SEQ ID NO: 1 - protein, 5 aa, Artificial Sequence
  Synthetic peptide
DYGIH

SEQ ID NO: 2 - protein, 17 aa, Artificial Sequence
  Synthetic peptide
VISYHGSNKYYARSVKG

SEQ ID NO: 3 - protein, 8 aa, Artificial Sequence
  Synthetic peptide
EIPFGMDV

SEQ ID NO: 4 - protein, 16 aa, Artificial Sequence
  Synthetic peptide
RSSQSLLHSDGYNYLD

SEQ ID NO: 5 - protein, 7 aa, Artificial Sequence
  Synthetic peptide
LGSNRAS

SEQ ID NO: 6 - protein, 9 aa, Artificial Sequence
  Synthetic peptide
MQALQTPLT

SEQ ID NO: 7 - protein, 117 aa, Artificial Sequence
  Synthetic peptide
QVQLVESGGGVVQSGRSLRLSCAASGFTFSDYGIHWVRQAPGKGLEWVAVISYHGSNKYYARSVKGRFTVSRDNSKNTLYLQMNSLRAEDTAVYYCAREIPFGMDVWGQGTTVTVSS

SEQ ID NO: 8 - protein, 112 aa, Artificial Sequence
  Synthetic peptide
DIVMTQTPLSLPVTPGEPASISCRSSQSLLHSDGYNYLDWYLQKPGQSPQLLIYLGSNRASGVPDRFSGSGSGTDFTLTISRVEAEDVGVYYCMQALQTPLTFGGGTKVDIK

SEQ ID NO: 9 - protein, 244 aa, Artificial Sequence
  Synthetic peptide
QVQLVESGGGVVQSGRSLRLSCAASGFTFSDYGIHWVRQAPGKGLEWVAVISYHGSNKYYARSVKGRFTVSRDNSKNTLYLQMNSLRAEDTAVYYCAREIPFGMDVWGQGTTVTVSSGGGGSGGGGSGGGGSDIVMTQTPLSLPVTPGEPASISCRSSQSLLHSDGYNYLDWYLQKPGQSPQLLIYLGSNRASGVPDRFSGSGSGTDFTLTISRVEAEDVGVYYCMQALQTPLTFGGGTKVDIK

SEQ ID NO: 10 - protein, 499 aa, Artificial Sequence
  Synthetic peptide
QVQLVESGGGVVQSGRSLRLSCAASGFTFSDYGIHWVRQAPGKGLEWVAVISYHGSNKYYARSVKGRFTVSRDNSKNTLYLQMNSLRAEDTAVYYCAREIPFGMDVWGQGTTVTVSSGGGGSGGGGSGGGGSDIVMTQTPLSLPVTPGEPASISCRSSQSLLHSDGYNYLDWYLQKPGQSPQLLIYLGSNRASGVPDRFSGSGSGTDFTLTISRVEAEDVGVYYCMQALQTPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 11 - protein, 5 aa, Artificial Sequence
  Synthetic peptide
GYYMH

SEQ ID NO: 12 - protein, 17 aa, Artificial Sequence
  Synthetic peptide
WINPNSGDTNYAQKFQG

SEQ ID NO: 13 - protein, 12 aa, Artificial Sequence
  Synthetic peptide
DANIAALDAFEI

SEQ ID NO: 14 - protein, 11 aa, Artificial Sequence
  Synthetic peptide
RASQSISSYLN

SEQ ID NO: 15 - protein, 7 aa, Artificial Sequence
  Synthetic peptide
AASSLQS

SEQ ID NO: 16 - protein, 9 aa, Artificial Sequence
  Synthetic peptide
QQSYSTPLT

SEQ ID NO: 17 - protein, 121 aa, Artificial Sequence
  Synthetic peptide
QVQLVQSGAEVKKPGASVKVSCKASGYTFTGYYMHWVRQAPGQGLEWMGWINPNSGDTNYAQKFQGRVTMTRDTSISTAYMELSRLTSDDTAVYYCARDANIAALDAFEIWGQGTMVTVSS

SEQ ID NO: 18 - protein, 107 aa, Artificial Sequence [sequence omitted]

SEQ ID NO: 19 - protein, 243 aa, Artificial Sequence
  Synthetic peptide
QVQLVQSGAEVKKPGASVKVSCKASGYTFTGYYMHWVRQAPGQGLEWMGWINPNSGDTNYAQKFQGRVTMTRDTSISTAYMELSRLTSDDTAVYYCARDANIAALDAFEIWGQGTMVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 20 - protein, 498 aa, Artificial Sequence
  Synthetic peptide
QVQLVQSGAEVKKPGASVKVSCKASGYTFTGYYMHWVRQAPGQGLEWMGWINPNSGDTNYAQKFQGRVTMTRDTSISTAYMELSRLTSDDTAVYYCARDANIAALDAFEIWGQGTMVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 21 - protein, 5 aa, Artificial Sequence
  Synthetic peptide
SYGMH

SEQ ID NO: 22 - protein, 17 aa, Artificial Sequence
  Synthetic peptide
VISYHGRDTYYARSVKG

SEQ ID NO: 23 - protein, 15 aa, Artificial Sequence
  Synthetic peptide
DGATVTSYYYSGMDV

SEQ ID NO: 24 - protein, 11 aa, Artificial Sequence
  Synthetic peptide
RASQGISNYLA

SEQ ID NO: 25 - protein, 7 aa, Artificial Sequence
  Synthetic peptide
LASSLQS

SEQ ID NO: 26 - protein, 9 aa, Artificial Sequence
  Synthetic peptide
QQYNFYPFT

SEQ ID NO: 27 - protein, 125 aa, Artificial Sequence
  Synthetic peptide
QVQLVESGGGVVQPGRSLRLSCAASGFTFSSYGMHWVRQAPGKGLEWVAVISYHGRDTYYARSVKGRFTISRDNSKNTLYLHMNSLRAEDTAVYYCARDGATVTSYYYSGMDVWGQGTTVTVSSK

SEQ ID NO: 28 - protein, 107 aa, Artificial Sequence
  Synthetic peptide
DIQMTQSPSSLSASVGDRVTITCRASQGISNYLAWFQQKPGKAPKSLIYLASSLQSGVPSKFSGSGSGTDFTLTISSLQPEDFATYYCQQYNFYPFTFGPGTKVDIK

SEQ ID NO: 29 - protein, 246 aa, Artificial Sequence
  Synthetic peptide
QVQLVESGGGVVQPGRSLRLSCAASGFTFSSYGMHWVRQAPGKGLEWVAVISYHGRDTYYARSVKGRFTISRDNSKNTLYLHMNSLRAEDTAVYYCARDGATVTSYYYSGMDVWGQGTTVTVSSGGGGSGGGGSGGGGSDIQMTQSPSSLSASVGDRVTITCRASQGISNYLAWFQQKPGKAPKSLIYLASSLQSGVPSKFSGSGSGTDFTLTISSLQPEDFATYYCQQYNFYPFTFGPGTKVDIK

SEQ ID NO: 30 - protein, 501 aa, Artificial Sequence
  Synthetic peptide
QVQLVESGGGVVQPGRSLRLSCAASGFTFSSYGMHWVRQAPGKGLEWVAVISYHGRDTYYARSVKGRFTISRDNSKNTLYLHMNSLRAEDTAVYYCARDGATVTSYYYSGMDVWGQGTTVTVSSGGGGSGGGGSGGGGSDIQMTQSPSSLSASVGDRVTITCRASQGISNYLAWFQQKPGKAPKSLIYLASSLQSGVPSKFSGSGSGTDFTLTISSLQPEDFATYYCQQYNFYPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 31 - protein, 5 aa, Artificial Sequence
  Synthetic peptide
SYYWS

SEQ ID NO: 32 - protein, 16 aa, Artificial Sequence
  Synthetic peptide
YVYYSGTTNYNPSLKS

SEQ ID NO: 33 - protein, 10 aa, Artificial Sequence
  Synthetic peptide
IAVTGFYFDY

SEQ ID NO: 34 - protein, 12 aa, Artificial Sequence
  Synthetic peptide
RASQRVNNNYLA

SEQ ID NO: 35 - protein, 7 aa, Artificial Sequence
  Synthetic peptide
GASSRAT

SEQ ID NO: 36 - protein, 9 aa, Artificial Sequence
  Synthetic peptide
QQYDRSPLT

SEQ ID NO: 37 - protein, 118 aa, Artificial Sequence
  Synthetic peptide
QVQLQESGPGLVKPSETLSLTCTVSGGSISSYYWSWIRQPPGKGLEWIGYVYYSGTTNYNPSLKSRVTISVDTSKNQFSLKLSSVTAADTAVYYCASIAVTGFYFDYWGQGTLVTVSS

SEQ ID NO: 38 - protein, 108 aa, Artificial Sequence
  Synthetic peptide
EIVLTQSPGTLSLSPGERVTLSCRASQRVNNNYLAWYQQRPGQAPRLLIYGASSRATGIPDRFSGSGSGTDFTLTISRLEPEDFAVYYCQQYDRSPLTFGGGTKLEIK

SEQ ID NO: 39 - protein, 241 aa, Artificial Sequence
  Synthetic peptide
QVQLQESGPGLVKPSETLSLTCTVSGGSISSYYWSWIRQPPGKGLEWIGYVYYSGTTNYNPSLKSRVTISVDTSKNQFSLKLSSVTAADTAVYYCASIAVTGFYFDYWGQGTLVTVSSGGGGSGGGGSGGGGSEIVLTQSPGTLSLSPGERVTLSCRASQRVNNNYLAWYQQRPGQAPRLLIYGASSRATGIPDRFSGSGSGTDFTLTISRLEPEDFAVYYCQQYDRSPLTFGGGTKLEIK

SEQ ID NO: 40 - protein, 496 aa, Artificial Sequence
  Synthetic peptide
QVQLQESGPGLVKPSETLSLTCTVSGGSISSYYWSWIRQPPGKGLEWIGYVYYSGTTNYNPSLKSRVTISVDTSKNQFSLKLSSVTAADTAVYYCASIAVTGFYFDYWGQGTLVTVSSGGGGSGGGGSGGGGSEIVLTQSPGTLSLSPGERVTLSCRASQRVNNNYLAWYQQRPGQAPRLLIYGASSRATGIPDRFSGSGSGTDFTLTISRLEPEDFAVYYCQQYDRSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 41 - protein, 5 aa, Artificial Sequence
  Synthetic peptide
SYYWS

SEQ ID NO: 42 - protein, 16 aa, Artificial Sequence
  Synthetic peptide
YIYYSGRTNYYPSLKS

SEQ ID NO: 43 - protein, 10 aa, Artificial Sequence
  Synthetic peptide
IAVAGFFFDY

SEQ ID NO: 44 - protein, 12 aa, Artificial Sequence
  Synthetic peptide
RASQSVNKNYLA

SEQ ID NO: 45 - protein, 7 aa, Artificial Sequence
  Synthetic peptide
GASSRAT

SEQ ID NO: 46 - protein, 9 aa, Artificial Sequence
  Synthetic peptide
QQYDRSPLT

SEQ ID NO: 47 - protein, 118 aa, Artificial Sequence
  Synthetic peptide
QVQLQESGPGLVKPSETLSLTCTVSGGSISSYYWSWIRQPPGKGLEWIGYIYYSGRTNYYPSLKSRVTISIDTSKNQFSLKLSSVTAADTAVYYCARIAVAGFFFDYWGQGTLVTVSS

SEQ ID NO: 48 - protein, 108 aa, Artificial Sequence
  Synthetic peptide
EIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGGGTKLEIK

SEQ ID NO: 49 - protein, 241 aa, Artificial Sequence
  Synthetic peptide
QVQLQESGPGLVKPSETLSLTCTVSGGSISSYYWSWIRQPPGKGLEWIGYIYYSGRTNYYPSLKSRVTISIDTSKNQFSLKLSSVTAADTAVYYCARIAVAGFFFDYWGQGTLVTVSSGGGGSGGGGSGGGGSEIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGGGTKLEIK

SEQ ID NO: 50 - protein, 496 aa, Artificial Sequence
  Synthetic peptide
QVQLQESGPGLVKPSETLSLTCTVSGGSISSYYWSWIRQPPGKGLEWIGYIYYSGRTNYYPSLKSRVTISIDTSKNQFSLKLSSVTAADTAVYYCARIAVAGFFFDYWGQGTLVTVSSGGGGSGGGGSGGGGSEIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 51 - protein, 5 aa, Artificial Sequence
  Synthetic peptide
SFYWS

SEQ ID NO: 52 - protein, 16 aa, Artificial Sequence
  Synthetic peptide
YIYYSGTTNYNPSLKS

SEQ ID NO: 53 - protein, 10 aa, Artificial Sequence
  Synthetic peptide
IAVAGFFFDY

SEQ ID NO: 54 - protein, 12 aa, Artificial Sequence
  Synthetic peptide
RASQSVNKNYLA

SEQ ID NO: 55 - protein, 7 aa, Artificial Sequence
  Synthetic peptide
GASSRAT

SEQ ID NO: 56 - protein, 9 aa, Artificial Sequence
  Synthetic peptide
QQYDRSPLT

SEQ ID NO: 57 - protein, 118 aa, Artificial Sequence
  Synthetic peptide
QVQLQESGPGLVKPSETLSLTCTVSGASISSFYWSWIRQPPGKGLEWIGYIYYSGTTNYNPSLKSRVTISVDTSKNQFSLKLSSVTAADTAVYYCARIAVAGFFFDYWGQGTLVTVSS

SEQ ID NO: 58 - protein, 108 aa, Artificial Sequence
  Synthetic peptide
EIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGGGTKVEIK

SEQ ID NO: 59 - protein, 241 aa, Artificial Sequence
  Synthetic peptide
QVQLQESGPGLVKPSETLSLTCTVSGASISSFYWSWIRQPPGKGLEWIGYIYYSGTTNYNPSLKSRVTISVDTSKNQFSLKLSSVTAADTAVYYCARIAVAGFFFDYWGQGTLVTVSSGGGGSGGGGSGGGGSEIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGGGTKVEIK

SEQ ID NO: 60 - protein, 496 aa, Artificial Sequence
  Synthetic peptide
QVQLQESGPGLVKPSETLSLTCTVSGASISSFYWSWIRQPPGKGLEWIGYIYYSGTTNYNPSLKSRVTISVDTSKNQFSLKLSSVTAADTAVYYCARIAVAGFFFDYWGQGTLVTVSSGGGGSGGGGSGGGGSEIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 61 - protein, 5 aa, Artificial Sequence
  Synthetic peptide
SFYWS

SEQ ID NO: 62 - protein, 16 aa, Artificial Sequence
  Synthetic peptide
YIYYSGTTNYNPSLKS

SEQ ID NO: 63 - protein, 10 aa, Artificial Sequence
  Synthetic peptide
IAVAGFFFDY

SEQ ID NO: 64 - protein, 12 aa, Artificial Sequence
  Synthetic peptide
RASQSVNKNYLA

SEQ ID NO: 65 - protein, 7 aa, Artificial Sequence
  Synthetic peptide
GASSRAT

SEQ ID NO: 66 - protein, 9 aa, Artificial Sequence
  Synthetic peptide
QQYDRSPLT

SEQ ID NO: 67 - protein, 118 aa, Artificial Sequence
  Synthetic peptide
QVQLQESGPGLVKPSQTLSLTCTVSGASISSFYWSWIRQPPGKGLEWIGYIYYSGTTNYNPSLKSRVTISVDTSKNQFSLKLSSVTAADTAVYYCARIAVAGFFFDYWGQGTLVTVSS

SEQ ID NO: 68 - protein, 108 aa, Artificial Sequence; identical to SEQ ID NO: 58
  Synthetic peptide

SEQ ID NO: 69 - protein, 241 aa, Artificial Sequence
  Synthetic peptide
QVQLQESGPGLVKPSQTLSLTCTVSGASISSFYWSWIRQPPGKGLEWIGYIYYSGTTNYNPSLKSRVTISVDTSKNQFSLKLSSVTAADTAVYYCARIAVAGFFFDYWGQGTLVTVSSGGGGSGGGGSGGGGSEIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGGGTKVEIK

SEQ ID NO: 70 - protein, 496 aa, Artificial Sequence
  Synthetic peptide
QVQLQESGPGLVKPSQTLSLTCTVSGASISSFYWSWIRQPPGKGLEWIGYIYYSGTTNYNPSLKSRVTISVDTSKNQFSLKLSSVTAADTAVYYCARIAVAGFFFDYWGQGTLVTVSSGGGGSGGGGSGGGGSEIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 71 - protein, 5 aa, Artificial Sequence
  Synthetic peptide
SFYWS

SEQ ID NO: 72 - protein, 16 aa, Artificial Sequence
  Synthetic peptide
YIYYSGTTNYNPSLKS

SEQ ID NO: 73 - protein, 10 aa, Artificial Sequence
  Synthetic peptide
IAVAGFFFDY

SEQ ID NO: 74 - protein, 12 aa, Artificial Sequence
  Synthetic peptide
RASQSVNKNYLA

SEQ ID NO: 75 - protein, 7 aa, Artificial Sequence
  Synthetic peptide
GASSRAT

SEQ ID NO: 76 - protein, 9 aa, Artificial Sequence
  Synthetic peptide
QQYDRSPLT

SEQ ID NO: 77 - protein, 119 aa, Artificial Sequence
  Synthetic peptide
QVQLQEWGPGLVKPSETLSLTCTVSGASISSFYWSWIRQPPGKGLEWIGYIYYSGTTNYNPSLKSRVTISVDTSKNQLSLKLSSVTAADTAVYYCARIAVAGFFFDYWGQGTLVTVSSK

SEQ ID NO: 78 - protein, 108 aa, Artificial Sequence
  Synthetic peptide
EIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGGGTKVDIK

SEQ ID NO: 79 - protein, 241 aa, Artificial Sequence
  Synthetic peptide
QVQLQEWGPGLVKPSETLSLTCTVSGASISSFYWSWIRQPPGKGLEWIGYIYYSGTTNYNPSLKSRVTISVDTSKNQLSLKLSSVTAADTAVYYCARIAVAGFFFDYWGQGTLVTVSSGGGGSGGGGSGGGGSEIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGGGTKVDIK

SEQ ID NO: 80 - protein, 496 aa, Artificial Sequence
  Synthetic peptide
QVQLQEWGPGLVKPSETLSLTCTVSGASISSFYWSWIRQPPGKGLEWIGYIYYSGTTNYNPSLKSRVTISVDTSKNQLSLKLSSVTAADTAVYYCARIAVAGFFFDYWGQGTLVTVSSGGGGSGGGGSGGGGSEIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 81 - protein, 5 aa, Artificial Sequence
  Synthetic peptide
SFYWS

SEQ ID NO: 82 - protein, 16 aa, Artificial Sequence
  Synthetic peptide
YIYYSGTTNYNPSLKS

SEQ ID NO: 83 - protein, 10 aa, Artificial Sequence
  Synthetic peptide
IAVAGFFFDY

SEQ ID NO: 84 - protein, 12 aa, Artificial Sequence
  Synthetic peptide
RASQSVNKNYLA

SEQ ID NO: 85 - protein, 7 aa, Artificial Sequence
  Synthetic peptide
GASSRAT

SEQ ID NO: 86 - protein, 9 aa, Artificial Sequence
  Synthetic peptide
QQYDRSPLT

SEQ ID NO: 87 - protein, 118 aa, Artificial Sequence; identical to SEQ ID NO: 57
  Synthetic peptide

SEQ ID NO: 88 - protein, 108 aa, Artificial Sequence
  Synthetic peptide
EIVLTQSPGTLSLSPGESATLSCRASQSVNKNYLAWYQQKPGQAPRLLIYGASSRATGIPDRFSGSGSGTDFTLTISRLEPEDFAVYYCQQYDRSPLTFGGGTRLEIK

SEQ ID NO: 89 - protein, 241 aa, Artificial Sequence
  Synthetic peptide
QVQLQESGPGLVKPSETLSLTCTVSGASISSFYWSWIRQPPGKGLEWIGYIYYSGTTNYNPSLKSRVTISVDTSKNQFSLKLSSVTAADTAVYYCARIAVAGFFFDYWGQGTLVTVSSGGGGSGGGGSGGGGSEIVLTQSPGTLSLSPGESATLSCRASQSVNKNYLAWYQQKPGQAPRLLIYGASSRATGIPDRFSGSGSGTDFTLTISRLEPEDFAVYYCQQYDRSPLTFGGGTRLEIK

SEQ ID NO: 90 - protein, 496 aa, Artificial Sequence
  Synthetic peptide
QVQLQESGPGLVKPSETLSLTCTVSGASISSFYWSWIRQPPGKGLEWIGYIYYSGTTNYNPSLKSRVTISVDTSKNQFSLKLSSVTAADTAVYYCARIAVAGFFFDYWGQGTLVTVSSGGGGSGGGGSGGGGSEIVLTQSPGTLSLSPGESATLSCRASQSVNKNYLAWYQQKPGQAPRLLIYGASSRATGIPDRFSGSGSGTDFTLTISRLEPEDFAVYYCQQYDRSPLTFGGGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 91 - protein, 5 aa, Artificial Sequence
  Synthetic peptide
SYYWS

SEQ ID NO: 92 - protein, 16 aa, Artificial Sequence
  Synthetic peptide
YIFYNGITNYNPSLKS

SEQ ID NO: 93 - protein, 10 aa, Artificial Sequence
  Synthetic peptide
IHSGSFSFDY

SEQ ID NO: 94 - protein, 12 aa, Artificial Sequence
  Synthetic peptide
RASQSVSRGYLA

SEQ ID NO: 95 - protein, 7 aa, Artificial Sequence
  Synthetic peptide
GASSRAT

SEQ ID NO: 96 - protein, 9 aa, Artificial Sequence
  Synthetic peptide
QQYDTSPIT

SEQ ID NO: 97 - protein, 118 aa, Artificial Sequence
  Synthetic peptide
QVQLQESGPGLVKPSQTLSLTCTVSGGSISSYYWSWIRQPPGKGLEWIGYIFYNGITNYNPSLKSRVTISLDTSKNQFSLKLSSVTAADTAKYYCARIHSGSFSFDYWDQGTLVTVSS

SEQ ID NO: 98 - protein, 108 aa, Artificial Sequence
  Synthetic peptide
EIVMTQSPGTLSLSPGERATLSCRASQSVSRGYLAWYQQKPGQAPRLLIYGASSRATDIPDRFSGSGSGTDFTLTISRLEPEDFAVYYCQQYDTSPITFGQGTKVEIK

SEQ ID NO: 99 - protein, 241 aa, Artificial Sequence
  Synthetic peptide
QVQLQESGPGLVKPSQTLSLTCTVSGGSISSYYWSWIRQPPGKGLEWIGYIFYNGITNYNPSLKSRVTISLDTSKNQFSLKLSSVTAADTAKYYCARIHSGSFSFDYWDQGTLVTVSSGGGGSGGGGSGGGGSEIVMTQSPGTLSLSPGERATLSCRASQSVSRGYLAWYQQKPGQAPRLLIYGASSRATDIPDRFSGSGSGTDFTLTISRLEPEDFAVYYCQQYDTSPITFGQGTKVEIK

SEQ ID NO: 100 - protein, 496 aa, Artificial Sequence
  Synthetic peptide
QVQLQESGPGLVKPSQTLSLTCTVSGGSISSYYWSWIRQPPGKGLEWIGYIFYNGITNYNPSLKSRVTISLDTSKNQFSLKLSSVTAADTAKYYCARIHSGSFSFDYWDQGTLVTVSSGGGGSGGGGSGGGGSEIVMTQSPGTLSLSPGERATLSCRASQSVSRGYLAWYQQKPGQAPRLLIYGASSRATDIPDRFSGSGSGTDFTLTISRLEPEDFAVYYCQQYDTSPITFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 101 - protein, 5 aa, Artificial Sequence
  Synthetic peptide
NAGMS

SEQ ID NO: 102 - protein, 19 aa, Artificial Sequence
  Synthetic peptide
RIKNKIDGGTTDFAAPVKG

SEQ ID NO: 103 - protein, 10 aa, Artificial Sequence
  Synthetic peptide
RGWYGDYFDY

SEQ ID NO: 104 - protein, 16 aa, Artificial Sequence
  Synthetic peptide
RSSQSLLHSNGYNYLD

SEQ ID NO: 105 - protein, 7 aa, Artificial Sequence
  Synthetic peptide
LGSNRAS

SEQ ID NO: 106 - protein, 9 aa, Artificial Sequence
  Synthetic peptide
MQALQTPFT

SEQ ID NO: 107 - protein, 121 aa, Artificial Sequence
  Synthetic peptide
EVQLVESGGGLVKPGGSLRLSCAASGFIFNNAGMSWVRQAPGKGLEWVGRIKNKIDGGTTDFAAPVKGRFTISRDDSKNTLYLQMNSLKAEDTAVYYCTARGWYGDYFDYWGQGTLVTVSS

SEQ ID NO: 108 - protein, 112 aa, Artificial Sequence
  Synthetic peptide
DIVMTQTPLSLPVTPGEPASISCRSSQSLLHSNGYNYLDWYLQKPGQSPQLLIYLGSNRASGVPDRFSGSGSGTDFTLKISRVEAEDVGIYYCMQALQTPFTFGPGTKVEIK

SEQ ID NO: 109 - protein, 248 aa, Artificial Sequence
  Synthetic peptide
EVQLVESGGGLVKPGGSLRLSCAASGFIFNNAGMSWVRQAPGKGLEWVGRIKNKIDGGTTDFAAPVKGRFTISRDDSKNTLYLQMNSLKAEDTAVYYCTARGWYGDYFDYWGQGTLVTVSSGGGGSGGGGSGGGGSDIVMTQTPLSLPVTPGEPASISCRSSQSLLHSNGYNYLDWYLQKPGQSPQLLIYLGSNRASGVPDRFSGSGSGTDFTLKISRVEAEDVGIYYCMQALQTPFTFGPGTKVEIK

SEQ ID NO: 110 - protein, 503 aa, Artificial Sequence
  Synthetic peptide
EVQLVESGGGLVKPGGSLRLSCAASGFIFNNAGMSWVRQAPGKGLEWVGRIKNKIDGGTTDFAAPVKGRFTISRDDSKNTLYLQMNSLKAEDTAVYYCTARGWYGDYFDYWGQGTLVTVSSGGGGSGGGGSGGGGSDIVMTQTPLSLPVTPGEPASISCRSSQSLLHSNGYNYLDWYLQKPGQSPQLLIYLGSNRASGVPDRFSGSGSGTDFTLKISRVEAEDVGIYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 111 - protein, 5 aa, Artificial Sequence
  Synthetic peptide
SYDIH

SEQ ID NO: 112 - protein, 17 aa, Artificial Sequence
  Synthetic peptide
VISSHGSNKNYARSVKG

SEQ ID NO: 113 - protein, 18 aa, Artificial Sequence
  Synthetic peptide
DGYSGNDPFYYYYHGMDV

SEQ ID NO: 114 - protein, 11 aa, Artificial Sequence
  Synthetic peptide
RASQSISSYLN

SEQ ID NO: 115 - protein, 7 aa, Artificial Sequence
  Synthetic peptide
AASSLQS

SEQ ID NO: 116 - protein, 9 aa, Artificial Sequence
  Synthetic peptide
QQSFTTPLT

SEQ ID NO: 117 - protein, 127 aa, Artificial Sequence
  Synthetic peptide
QVQLVESGGGVVQPGRSLRLSCAASGFSFSSYDIHWVRQAPGKGLEWVAVISSHGSNKNYARSVKGRFTISRDNSKNTLYLQMNSLKAEDTAVYYCARDGYSGNDPFYYYYHGMDVWGQGTTVTVSS

SEQ ID NO: 118 - protein, 107 aa, Artificial Sequence
  Synthetic peptide
DIQMTQSPSSLSASVGDRVTITCRASQSISSYLNWYQQKPGKAPKLLIYAASSLQSGVPSRFSGSGSGTDFSLTISSLQPEDFATYYCQQSFTTPLTFGGGTKVEIK

SEQ ID NO: 119 - protein, 249 aa, Artificial Sequence
  Synthetic peptide
QVQLVESGGGVVQPGRSLRLSCAASGFSFSSYDIHWVRQAPGKGLEWVAVISSHGSNKNYARSVKGRFTISRDNSKNTLYLQMNSLKAEDTAVYYCARDGYSGNDPFYYYYHGMDVWGQGTTVTVSSGGGGSGGGGSGGGGSDIQMTQSPSSLSASVGDRVTITCRASQSISSYLNWYQQKPGKAPKLLIYAASSLQSGVPSRFSGSGSGTDFSLTISSLQPEDFATYYCQQSFTTPLTFGGGTKVEIK

SEQ ID NO: 120 - protein, 504 aa, Artificial Sequence
  Synthetic peptide
QVQLVESGGGVVQPGRSLRLSCAASGFSFSSYDIHWVRQAPGKGLEWVAVISSHGSNKNYARSVKGRFTISRDNSKNTLYLQMNSLKAEDTAVYYCARDGYSGNDPFYYYYHGMDVWGQGTTVTVSSGGGGSGGGGSGGGGSDIQMTQSPSSLSASVGDRVTITCRASQSISSYLNWYQQKPGKAPKLLIYAASSLQSGVPSRFSGSGSGTDFSLTISSLQPEDFATYYCQQSFTTPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 121 - protein, 5 aa, Artificial Sequence
  Synthetic peptide
SYYMH

SEQ ID NO: 122 - protein, 17 aa, Artificial Sequence
  Synthetic peptide
IINPSDGSTNYAQNFQG

SEQ ID NO: 123 - protein, 14 aa, Artificial Sequence
  Synthetic peptide
GGNSAFYSYYDMDV

SEQ ID NO: 124 - protein, 16 aa, Artificial Sequence
  Synthetic peptide
RSSQSLVYRDGNTYLS

SEQ ID NO: 125 - protein, 7 aa, Artificial Sequence
  Synthetic peptide
KVSNWQS

SEQ ID NO: 126 - protein, 9 aa, Artificial Sequence
  Synthetic peptide
MQGTHWPPT

SEQ ID NO: 127 - protein, 123 aa, Artificial Sequence
  Synthetic peptide
QVQLVQSGAEVKKPGASVKVSCKASGYTFTSYYMHWVRQAPGQGLEWMGIINPSDGSTNYAQNFQGRVTMTRDTSTNTVYMELSSLRSEDTAVYYCARGGNSAFYSYYDMDVWGQGTTVTVSS

SEQ ID NO: 128 - protein, 112 aa, Artificial Sequence
  Synthetic peptide
DVVMTQSPLSLPVTLGQPASISCRSSQSLVYRDGNTYLSWFQQRPGQSPRRLIYKVSNWQSGVPDRFSGSGSGTDFTLKISRVEAEDVGVYFCMQGTHWPPTFGQGTKVEIK

SEQ ID NO: 129 - protein, 250 aa, Artificial Sequence
  Synthetic peptide
QVQLVQSGAEVKKPGASVKVSCKASGYTFTSYYMHWVRQAPGQGLEWMGIINPSDGSTNYAQNFQGRVTMTRDTSTNTVYMELSSLRSEDTAVYYCARGGNSAFYSYYDMDVWGQGTTVTVSSGGGGSGGGGSGGGGSDVVMTQSPLSLPVTLGQPASISCRSSQSLVYRDGNTYLSWFQQRPGQSPRRLIYKVSNWQSGVPDRFSGSGSGTDFTLKISRVEAEDVGVYFCMQGTHWPPTFGQGTKVEIK

SEQ ID NO: 130 - protein, 505 aa, Artificial Sequence
  Synthetic peptide
QVQLVQSGAEVKKPGASVKVSCKASGYTFTSYYMHWVRQAPGQGLEWMGIINPSDGSTNYAQNFQGRVTMTRDTSTNTVYMELSSLRSEDTAVYYCARGGNSAFYSYYDMDVWGQGTTVTVSSGGGGSGGGGSGGGGSDVVMTQSPLSLPVTLGQPASISCRSSQSLVYRDGNTYLSWFQQRPGQSPRRLIYKVSNWQSGVPDRFSGSGSGTDFTLKISRVEAEDVGVYFCMQGTHWPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 131 - protein, 5 aa, Artificial Sequence
  Synthetic peptide
NYYMH

SEQ ID NO: 132 - protein, 17 aa, Artificial Sequence
  Synthetic peptide
IINPSDGSTSYAQKFQG

SEQ ID NO: 133 - protein, 14 aa, Artificial Sequence
  Synthetic peptide
GGNSAFYSYYDMDV

SEQ ID NO: 134 - protein, 16 aa, Artificial Sequence
  Synthetic peptide
RSSQSLVYRDGNTYLS

SEQ ID NO: 135 - protein, 7 aa, Artificial Sequence
  Synthetic peptide
KVSNWQS

SEQ ID NO: 136 - protein, 9 aa, Artificial Sequence
  Synthetic peptide
MQGTHWPPT

SEQ ID NO: 137 - protein, 123 aa, Artificial Sequence
  Synthetic peptide
QVQLVQSGAEVKKPGASVKVSCKASGYTFTNYYMHWVRQAPGLGLEWMGIINPSDGSTSYAQKFQGRVTMTRDTSTNTVYMDLSSLRSEDTAVYYCARGGNSAFYSYYDMDVWGQGTTVTVSS

SEQ ID NO: 138 - protein, 112 aa, Artificial Sequence
  Synthetic peptide
DVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGQGTKVEIK

SEQ ID NO: 139 - protein, 250 aa, Artificial Sequence
  Synthetic peptide
QVQLVQSGAEVKKPGASVKVSCKASGYTFTNYYMHWVRQAPGLGLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGQGTKVEIK

SEQ ID NO: 140 - protein, 505 aa, Artificial Sequence
  Synthetic peptide
QVQLVQSGAEVKKPGASVKVSCKASGYTFTNYYMHWVRQAPGLGLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 141 - protein, 5 aa, Artificial Sequence
  Synthetic peptide
GYYIH

SEQ ID NO: 142 - protein, 17 aa, Artificial Sequence
  Synthetic peptide
IINPSDGSTSYGQNFQG

SEQ ID NO: 143 - protein, 14 aa, Artificial Sequence
  Synthetic peptide
GGNSAFYSYYDMDV

SEQ ID NO: 144 - protein, 16 aa, Artificial Sequence
  Synthetic peptide
RSSQSLAYRDGNTYLS

SEQ ID NO: 145 - protein, 7 aa, Artificial Sequence
  Synthetic peptide
KVSNWQS

SEQ ID NO: 146 - protein, 9 aa, Artificial Sequence
  Synthetic peptide
MQGTHWPPT

SEQ ID NO: 147 - protein, 123 aa, Artificial Sequence
  Synthetic peptide
QVQLVQSGAEVKKPGASVKVSCKASGYTFTGYYIHWVRQAPGQGLEWMGIINPSDGSTSYGQNFQGRVTMTRDTSTNTVYMELSSLRSEDTAVYYCARGGNSAFYSYYDMDVWGQGTTVTVSS

SEQ ID NO: 148 - protein, 112 aa, Artificial Sequence
  Synthetic peptide
DVVMTQSPLSLPVTLGQPASISCRSSQSLAYRDGNTYLSWFQQRPGQSPRRLIYKVSNWQSGVPDRFSGSGSGTDFTLKISRVEAEDVGVYFCMQGTHWPPTFGQGTKVEIK

SEQ ID NO: 149 - protein, 250 aa, Artificial Sequence
  Synthetic peptide
QVQLVQSGAEVKKPGASVKVSCKASGYTFTGYYIHWVRQAPGQGLEWMGIINPSDGSTSYGQNFQGRVTMTRDTSTNTVYMELSSLRSEDTAVYYCARGGNSAFYSYYDMDVWGQGTTVTVSSGGGGSGGGGSGGGGSDVVMTQSPLSLPVTLGQPASISCRSSQSLAYRDGNTYLSWFQQRPGQSPRRLIYKVSNWQSGVPDRFSGSGSGTDFTLKISRVEAEDVGVYFCMQGTHWPPTFGQGTKVEIK

SEQ ID NO: 150 - protein, 505 aa, Artificial Sequence
  Synthetic peptide
QVQLVQSGAEVKKPGASVKVSCKASGYTFTGYYIHWVRQAPGQGLEWMGIINPSDGSTSYGQNFQGRVTMTRDTSTNTVYMELSSLRSEDTAVYYCARGGNSAFYSYYDMDVWGQGTTVTVSSGGGGSGGGGSGGGGSDVVMTQSPLSLPVTLGQPASISCRSSQSLAYRDGNTYLSWFQQRPGQSPRRLIYKVSNWQSGVPDRFSGSGSGTDFTLKISRVEAEDVGVYFCMQGTHWPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 151 - protein, 5 aa, Artificial Sequence
  Synthetic peptide
GHYMH

SEQ ID NO: 152 - protein, 17 aa, Artificial Sequence
  Synthetic peptide
IINPSDGSTNYAQKFQG

SEQ ID NO: 153 - protein, 14 aa, Artificial Sequence
  Synthetic peptide
GTTVVHYSYYDMDV

SEQ ID NO: 154 - protein, 16 aa, Artificial Sequence
  Synthetic peptide
RSSQSLVYRDGNTYLT

SEQ ID NO: 155 - protein, 7 aa, Artificial Sequence
  Synthetic peptide
KVSNWQS

SEQ ID NO: 156 - protein, 9 aa, Artificial Sequence
  Synthetic peptide
MQGTHWPPT

SEQ ID NO: 157 - protein, 123 aa, Artificial Sequence
  Synthetic peptide
QVQLVQSGAEVKKPGASVKVSCKASGYTFTGHYMHWVRQAPGQGLEWMGIINPSDGSTNYAQKFQGRVTMTRDTSTSTVYMELRSLRSEDTAVYYCTRGTTVVHYSYYDMDVWGQGTTVTVSS

SEQ ID NO: 158 - protein, 112 aa, Artificial Sequence
  Synthetic peptide
DVVMTQTPLSLPVTLGQPASISCRSSQSLVYRDGNTYLTWFQQRPGQSPRRLIYKVSNWQSGVPDRFSGSGSGTDFTLKISRVEAEDVGVYYCMQGTHWPPTFGGGTKVEIK

SEQ ID NO: 159 - protein, 250 aa, Artificial Sequence
  Synthetic peptide
QVQLVQSGAEVKKPGASVKVSCKASGYTFTGHYMHWVRQAPGQGLEWMGIINPSDGSTNYAQKFQGRVTMTRDTSTSTVYMELRSLRSEDTAVYYCTRGTTVVHYSYYDMDVWGQGTTVTVSSGGGGSGGGGSGGGGSDVVMTQTPLSLPVTLGQPASISCRSSQSLVYRDGNTYLTWFQQRPGQSPRRLIYKVSNWQSGVPDRFSGSGSGTDFTLKISRVEAEDVGVYYCMQGTHWPPTFGGGTKVEIK

SEQ ID NO: 160 - protein, 505 aa, Artificial Sequence
  Synthetic peptide
QVQLVQSGAEVKKPGASVKVSCKASGYTFTGHYMHWVRQAPGQGLEWMGIINPSDGSTNYAQKFQGRVTMTRDTSTSTVYMELRSLRSEDTAVYYCTRGTTVVHYSYYDMDVWGQGTTVTVSSGGGGSGGGGSGGGGSDVVMTQTPLSLPVTLGQPASISCRSSQSLVYRDGNTYLTWFQQRPGQSPRRLIYKVSNWQSGVPDRFSGSGSGTDFTLKISRVEAEDVGVYYCMQGTHWPPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 161 - protein, 5 aa, Artificial Sequence
  Synthetic peptide
NYFMH

SEQ ID NO: 162 - protein, 17 aa, Artificial Sequence
  Synthetic peptide
IINPSDGSTSYAQNFQG

SEQ ID NO: 163 - protein, 14 aa, Artificial Sequence
  Synthetic peptide
GGNSAFYSYYDMDV

SEQ ID NO: 164 - protein, 16 aa, Artificial Sequence
  Synthetic peptide
RSSQSLVYRDGNTYLS

SEQ ID NO: 165 - protein, 7 aa, Artificial Sequence
  Synthetic peptide
RVSNWQS

SEQ ID NO: 166 - protein, 9 aa, Artificial Sequence
  Synthetic peptide
MQGTYWPPT

SEQ ID NO: 167 - protein, 123 aa, Artificial Sequence
  Synthetic peptide
QVQLVQSGAEVKKPGASVKVSCKASGYTFTNYFMHWVRQAPGLGLEWMGIINPSDGSTSYAQNFQGRVTMTRDTSTNTVYMELSSLRSEDTAVYYCARGGNSAFYSYYDMDVWGQGTTVTVSS

SEQ ID NO: 168 - protein, 112 aa, Artificial Sequence
  Synthetic peptide
DVVMTQSPLSLPVTLGQPASISCRSSQSLVYRDGNTYLSWFQQRPGQSPRRLIYRVSNWQSGVPDRFSGSGSGTDFTLKISRVEAEDVGVYFCMQGTYWPPTFGQGTKVDIK

SEQ ID NO: 169 - protein, 250 aa, Artificial Sequence
  Synthetic peptide
QVQLVQSGAEVKKPGASVKVSCKASGYTFTNYFMHWVRQAPGLGLEWMGIINPSDGSTSYAQNFQGRVTMTRDTSTNTVYMELSSLRSEDTAVYYCARGGNSAFYSYYDMDVWGQGTTVTVSSGGGGSGGGGSGGGGSDVVMTQSPLSLPVTLGQPASISCRSSQSLVYRDGNTYLSWFQQRPGQSPRRLIYRVSNWQSGVPDRFSGSGSGTDFTLKISRVEAEDVGVYFCMQGTYWPPTFGQGTKVDIK

SEQ ID NO: 170 - protein, 505 aa, Artificial Sequence
  Synthetic peptide
QVQLVQSGAEVKKPGASVKVSCKASGYTFTNYFMHWVRQAPGLGLEWMGIINPSDGSTSYAQNFQGRVTMTRDTSTNTVYMELSSLRSEDTAVYYCARGGNSAFYSYYDMDVWGQGTTVTVSSGGGGSGGGGSGGGGSDVVMTQSPLSLPVTLGQPASISCRSSQSLVYRDGNTYLSWFQQRPGQSPRRLIYRVSNWQSGVPDRFSGSGSGTDFTLKISRVEAEDVGVYFCMQGTYWPPTFGQGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 171 - protein, 5 aa, Artificial Sequence
  Synthetic peptide
NYGMH

SEQ ID NO: 172 - protein, 17 aa, Artificial Sequence
  Synthetic peptide
VISHHGSSKYYARSVKG

SEQ ID NO: 173 - protein, 9 aa, Artificial Sequence
  Synthetic peptide
DWWELVFDY

SEQ ID NO: 174 - protein, 16 aa, Artificial Sequence
  Synthetic peptide
KSSQSLLHSDGKTFLY

SEQ ID NO: 175 - protein, 7 aa, Artificial Sequence
  Synthetic peptide
EVSNRFS

SEQ ID NO: 176 - protein, 9 aa, Artificial Sequence
  Synthetic peptide
LQGIHLPFT

SEQ ID NO: 177 - protein, 118 aa, Artificial Sequence
  Synthetic peptide
QVQLVESGGGAVQPGRSLRLSCAASGFTFSNYGMHWVRQAPGKGLEWVAVISHHGSSKYYARSVKGRFTISRDNSKNTLYLEMNSLRAEDTAVYYCARDWWELVFDYWGQGTLVTVSS

SEQ ID NO: 178 - protein, 112 aa, Artificial Sequence
  Synthetic peptide
DIVMTQTPLSLSVTPGQPASISCKSSQSLLHSDGKTFLYWYLQKPGQPPQLLIYEVSNRFSGVPDRFSGSGSGTDFTLKISRVEAEDVGVYYCLQGIHLPFTFGPGTKVEIK

SEQ ID NO: 179 - protein, 245 aa, Artificial Sequence
  Synthetic peptide
QVQLVESGGGAVQPGRSLRLSCAASGFTFSNYGMHWVRQAPGKGLEWVAVISHHGSSKYYARSVKGRFTISRDNSKNTLYLEMNSLRAEDTAVYYCARDWWELVFDYWGQGTLVTVSSGGGGSGGGGSGGGGSDIVMTQTPLSLSVTPGQPASISCKSSQSLLHSDGKTFLYWYLQKPGQPPQLLIYEVSNRFSGVPDRFSGSGSGTDFTLKISRVEAEDVGVYYCLQGIHLPFTFGPGTKVEIK

SEQ ID NO: 180 - protein, 500 aa, Artificial Sequence
  Synthetic peptide
QVQLVESGGGAVQPGRSLRLSCAASGFTFSNYGMHWVRQAPGKGLEWVAVISHHGSSKYYARSVKGRFTISRDNSKNTLYLEMNSLRAEDTAVYYCARDWWELVFDYWGQGTLVTVSSGGGGSGGGGSGGGGSDIVMTQTPLSLSVTPGQPASISCKSSQSLLHSDGKTFLYWYLQKPGQPPQLLIYEVSNRFSGVPDRFSGSGSGTDFTLKISRVEAEDVGVYYCLQGIHLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 181 - protein, 7 aa, Artificial Sequence
  Synthetic peptide
NSRMGVS

SEQ ID NO: 182 - protein, 16 aa, Artificial Sequence
  Synthetic peptide
HIFSNDGKSYSTSLKS

SEQ ID NO: 183 - protein, 15 aa, Artificial Sequence
  Synthetic peptide
YNYDSSGYYYSFFDY

SEQ ID NO: 184 - protein, 11 aa, Artificial Sequence
  Synthetic peptide
RASQSISSYLN

SEQ ID NO: 185 - protein, 7 aa, Artificial Sequence
  Synthetic peptide
AASSLQS

SEQ ID NO: 186 - protein, 9 aa, Artificial Sequence
  Synthetic peptide
QQGYSSPFT

SEQ ID NO: 187 - protein, 125 aa, Artificial Sequence
  Synthetic peptide
QVTLKESGPMLVKPTETLTLTCTVSGFSLSNSRMGVSWIRQPPGRALEWLAHIFSNDGKSYSTSLKSRLTISKDTSKSQVVLTMTNMDPVDTATYYCARYNYDSSGYYYSFFDYWGQGTLVTVSS

SEQ ID NO: 188 - protein, 107 aa, Artificial Sequence
  Synthetic peptide
DIQMTQSPSSLSASVGDRVTITCRASQSISSYLNWYQQKPGKAPKLLIYAASSLQSGVPSRFSGSGSGTDFTLTISSLQPEDFATYYCQQGYSSPFTFGGGTKVEIK

SEQ ID NO: 189 - protein, 247 aa, Artificial Sequence
  Synthetic peptide
QVTLKESGPMLVKPTETLTLTCTVSGFSLSNSRMGVSWIRQPPGRALEWLAHIFSNDGKSYSTSLKSRLTISKDTSKSQVVLTMTNMDPVDTATYYCARYNYDSSGYYYSFFDYWGQGTLVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQGYSSPFTFGGGTKVEIK

SEQ ID NO: 190 - protein, 502 aa, Artificial Sequence
  Synthetic peptide
QVTLKESGPMLVKPTETLTLTCTVSGFSLSNSRMGVSWIRQPPGRALEWLAHIFSNDGKSYSTSLKSRLTISKDTSKSQVVLTMTNMDPVDTATYYCARYNYDSSGYYYSFFDYWGQGTLVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQGYSSPFTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 191 - protein, 7 aa, Artificial Sequence
  Synthetic peptide
NARMGVS

SEQ ID NO: 192 - protein, 16 aa, Artificial Sequence
  Synthetic peptide
HIFSTDEKSYSTSLKS

SEQ ID NO: 193 - protein, 15 aa, Artificial Sequence
  Synthetic peptide
YYYDSSGYYYSFFDY

SEQ ID NO: 194 - protein, 11 aa, Artificial Sequence
  Synthetic peptide
RASQSIRSYLN

SEQ ID NO: 195 - protein, 7 aa, Artificial Sequence
  Synthetic peptide
GASNLQS

SEQ ID NO: 196 - protein, 9 aa, Artificial Sequence
  Synthetic peptide
QQSYSSPFT

SEQ ID NO: 197 - protein, 125 aa, Artificial Sequence
  Synthetic peptide
QVTLKESGPVLVKPTETLTLTCTVSGFSLSNARMGVSWLRQPPGKALEWLAHIFSTDEKSYSTSLKSRLTISKDTSKSQVVLTMTNMDPVDTATYYCARYYYDSSGYYYSFFDYWGQGTLVTVSS

SEQ ID NO: 198 - protein, 107 aa, Artificial Sequence
  Synthetic peptide
DIQMTQSPSSLSASVGDRVTITCRASQSIRSYLNWYQQKPGKAPKLLIYGASNLQSGVPSRFSGSGSGTDFTLTISSLQPEDFATYYCQQSYSSPFTFGGGTKVEIK

SEQ ID NO: 199 - protein, 247 aa, Artificial Sequence
  Synthetic peptide
QVTLKESGPVLVKPTETLTLTCTVSGFSLSNARMGVSWLRQPPGKALEWLAHIFSTDEKSYSTSLKSRLTISKDTSKSQVVLTMTNMDPVDTATYYCARYYYDSSGYYYSFFDYWGQGTLVTVSSGGGGSGGGGSGGGGSDIQMTQSPSSLSASVGDRVTITCRASQSIRSYLNWYQQKPGKAPKLLIYGASNLQSGVPSRFSGSGSGTDFTLTISSLQPEDFATYYCQQSYSSPFTFGGGTKVEIK

SEQ ID NO: 200 - protein, 502 aa, Artificial Sequence
  Synthetic peptide
QVTLKESGPVLVKPTETLTLTCTVSGFSLSNARMGVSWLRQPPGKALEWLAHIFSTDEKSYSTSLKSRLTISKDTSKSQVVLTMTNMDPVDTATYYCARYYYDSSGYYYSFFDYWGQGTLVTVSSGGGGSGGGGSGGGGSDIQMTQSPSSLSASVGDRVTITCRASQSIRSYLNWYQQKPGKAPKLLIYGASNLQSGVPSRFSGSGSGTDFTLTISSLQPEDFATYYCQQSYSSPFTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 201 - protein, 5 aa, Artificial Sequence
  Synthetic peptide
SYYIH

SEQ ID NO: 202 - protein, 17 aa, Artificial Sequence
  Synthetic peptide
IINPSGGSKSYAQKFRG

SEQ ID NO: 203 - protein, 12 aa, Artificial Sequence
  Synthetic peptide
SMSTVTSDAFDI

SEQ ID NO: 204 - protein, 11 aa, Artificial Sequence
  Synthetic peptide
RASQSISNYLN

SEQ ID NO: 205 - protein, 7 aa, Artificial Sequence
  Synthetic peptide
AASSLQS

SEQ ID NO: 206 - protein, 9 aa, Artificial Sequence
  Synthetic peptide
QQSYSAPLT

SEQ ID NO: 207 - protein, 121 aa, Artificial Sequence
  Synthetic peptide
QVQLVQSGAEVKKPGASVKVSCKASGYAFTSYYIHWVRQAPGQGLEWMGIINPSGGSKSYAQKFRGRVTMTRDTSTSTVYMELSSLTSEDTAVYYCARSMSTVTSDAFDIWGQGTMVTVSS

SEQ ID NO: 208 - protein, 107 aa, Artificial Sequence
  Synthetic peptide
DIQMTQSPSSLSASVGDRVTITCRASQSISNYLNWYQQKPGKAPKLLIYAASSLQSGVPSRFSGSGSGTEFTLTISSLQPEDFATYYCQQSYSAPLTFGGGTKVDIK

SEQ ID NO: 209 - protein, 243 aa, Artificial Sequence
  Synthetic peptide
QVQLVQSGAEVKKPGASVKVSCKASGYAFTSYYIHWVRQAPGQGLEWMGIINPSGGSKSYAQKFRGRVTMTRDTSTSTVYMELSSLTSEDTAVYYCARSMSTVTSDAFDIWGQGTMVTVSSGGGGSGGGGSGGGGSDIQMTQSPSSLSASVGDRVTITCRASQSISNYLNWYQQKPGKAPKLLIYAASSLQSGVPSRFSGSGSGTEFTLTISSLQPEDFATYYCQQSYSAPLTFGGGTKVDIK

SEQ ID NO: 210 - protein, 498 aa, Artificial Sequence
  Synthetic peptide
QVQLVQSGAEVKKPGASVKVSCKASGYAFTSYYIHWVRQAPGQGLEWMGIINPSGGSKSYAQKFRGRVTMTRDTSTSTVYMELSSLTSEDTAVYYCARSMSTVTSDAFDIWGQGTMVTVSSGGGGSGGGGSGGGGSDIQMTQSPSSLSASVGDRVTITCRASQSISNYLNWYQQKPGKAPKLLIYAASSLQSGVPSRFSGSGSGTEFTLTISSLQPEDFATYYCQQSYSAPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 211 - protein, 496 aa, Artificial Sequence
  Synthetic peptide
QVQLQESGPGLVKPSETLSLTCTVSGGSISSYYWSWIRQPPGKGLEWIGYVYYSGTTNYNPSLKSRVTISVDTSKNQFSLKLSSVTAADTAVYYCASIAVTGFYFDYWGQGTLVTVSSGGGGSGGGGSGGGGSEIVLTQSPGTLSLSPGERVTLSCRASQRVNNNYLAWYQQRPGQAPRLLIYGASSRATGIPDRFSGSGSGTDFTLTISRLEPEDFAVYYCQQYDRSPLTFGGGTKLEIKSGGGGSEVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 212 - protein, 496 aa, Artificial Sequence
  Synthetic peptide
QVQLQESGPGLVKPSETLSLTCTVSGGSISSYYWSWIRQPPGKGLEWIGYIYYSGRTNYYPSLKSRVTISIDTSKNQFSLKLSSVTAADTAVYYCARIAVAGFFFDYWGQGTLVTVSSGGGGSGGGGSGGGGSEIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGGGTKLEIKSGGGGSEVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 213 - protein, 496 aa, Artificial Sequence
  Synthetic peptide
QVQLQESGPGLVKPSETLSLTCTVSGASISSFYWSWIRQPPGKGLEWIGYIYYSGTTNYNPSLKSRVTISVDTSKNQFSLKLSSVTAADTAVYYCARIAVAGFFFDYWGQGTLVTVSSGGGGSGGGGSGGGGSEIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGGGTKVEIKSGGGGSEVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 214 - protein, 496 aa, Artificial Sequence
  Synthetic peptide
QVQLQESGPGLVKPSQTLSLTCTVSGASISSFYWSWIRQPPGKGLEWIGYIYYSGTTNYNPSLKSRVTISVDTSKNQFSLKLSSVTAADTAVYYCARIAVAGFFFDYWGQGTLVTVSSGGGGSGGGGSGGGGSEIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGGGTKVEIKSGGGGSEVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 215 - protein, 496 aa, Artificial Sequence
  Synthetic peptide
QVQLQEWGPGLVKPSETLSLTCTVSGASISSFYWSWIRQPPGKGLEWIGYIYYSGTTNYNPSLKSRVTISVDTSKNQLSLKLSSVTAADTAVYYCARIAVAGFFFDYWGQGTLVTVSSGGGGSGGGGSGGGGSEIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGGGTKVDIKSGGGGSEVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 216 - protein, 496 aa, Artificial Sequence
  Synthetic peptide
QVQLQESGPGLVKPSETLSLTCTVSGASISSFYWSWIRQPPGKGLEWIGYIYYSGTTNYNPSLKSRVTISVDTSKNQFSLKLSSVTAADTAVYYCARIAVAGFFFDYWGQGTLVTVSSGGGGSGGGGSGGGGSEIVLTQSPGTLSLSPGESATLSCRASQSVNKNYLAWYQQKPGQAPRLLIYGASSRATGIPDRFSGSGSGTDFTLTISRLEPEDFAVYYCQQYDRSPLTFGGGTRLEIKSGGGGSEVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 217 - protein, 496 aa, Artificial Sequence
  Synthetic peptide
QVQLQESGPGLVKPSQTLSLTCTVSGGSISSYYWSWIRQPPGKGLEWIGYIFYNGITNYNPSLKSRVTISLDTSKNQFSLKLSSVTAADTAKYYCARIHSGSFSFDYWDQGTLVTVSSGGGGSGGGGSGGGGSEIVMTQSPGTLSLSPGERATLSCRASQSVSRGYLAWYQQKPGQAPRLLIYGASSRATDIPDRFSGSGSGTDFTLTISRLEPEDFAVYYCQQYDTSPITFGQGTKVEIKSGGGGSEVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 218 - protein, 505 aa, Artificial Sequence
  Synthetic peptide
QVQLVQSGAEVKKPGASVKVSCKASGYTFTSYYMHWVRQAPGQGLEWMGIINPSDGSTNYAQNFQGRVTMTRDTSTNTVYMELSSLRSEDTAVYYCARGGNSAFYSYYDMDVWGQGTTVTVSSGGGGSGGGGSGGGGSDVVMTQSPLSLPVTLGQPASISCRSSQSLVYRDGNTYLSWFQQRPGQSPRRLIYKVSNWQSGVPDRFSGSGSGTDFTLKISRVEAEDVGVYFCMQGTHWPPTFGQGTKVEIKSGGGGSEVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 219 - protein, 505 aa, Artificial Sequence
  Synthetic peptide
QVQLVQSGAEVKKPGASVKVSCKASGYTFTNYYMHWVRQAPGLGLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGQGTKVEIKSGGGGSEVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 220 - protein, 505 aa, Artificial Sequence
  Synthetic peptide
QVQLVQSGAEVKKPGASVKVSCKASGYTFTGYYIHWVRQAPGQGLEWMGIINPSDGSTSYGQNFQGRVTMTRDTSTNTVYMELSSLRSEDTAVYYCARGGNSAFYSYYDMDVWGQGTTVTVSSGGGGSGGGGSGGGGSDVVMTQSPLSLPVTLGQPASISCRSSQSLAYRDGNTYLSWFQQRPGQSPRRLIYKVSNWQSGVPDRFSGSGSGTDFTLKISRVEAEDVGVYFCMQGTHWPPTFGQGTKVEIKSGGGGSEVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 221 - protein, 1096 aa, Artificial Sequence
  Synthetic peptide
QVQLVESGGGVVQSGRSLRLSCAASGFTFSDYGIHWVRQAPGKGLEWVAVISYHGSNKYYARSVKGRFTVSRDNSKNTLYLQMNSLRAEDTAVYYCAREIPFGMDVWGQGTTVTVSSGGGGSGGGGSGGGGSDIVMTQTPLSLPVTPGEPASISCRSSQSLLHSDGYNYLDWYLQKPGQSPQLLIYLGSNRASGVPDRFSGSGSGTDFTLTISRVEAEDVGVYYCMQALQTPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 222 - protein, 1095 aa, Artificial Sequence
  Synthetic peptide
QVQLVQSGAEVKKPGASVKVSCKASGYTFTGYYMHWVRQAPGQGLEWMGWINPNSGDTNYAQKFQGRVTMTRDTSISTAYMELSRLTSDDTAVYYCARDANIAALDAFEIWGQGTMVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 223 - protein, 1098 aa, Artificial Sequence
  Synthetic peptide
QVQLVESGGGVVQPGRSLRLSCAASGFTFSSYGMHWVRQAPGKGLEWVAVISYHGRDTYYARSVKGRFTISRDNSKNTLYLHMNSLRAEDTAVYYCARDGATVTSYYYSGMDVWGQGTTVTVSSGGGGSGGGGSGGGGSDIQMTQSPSSLSASVGDRVTITCRASQGISNYLAWFQQKPGKAPKSLIYLASSLQSGVPSKFSGSGSGTDFTLTISSLQPEDFATYYCQQYNFYPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 224 - protein, 1093 aa, Artificial Sequence
  Synthetic peptide
QVQLQESGPGLVKPSETLSLTCTVSGGSISSYYWSWIRQPPGKGLEWIGYVYYSGTTNYNPSLKSRVTISVDTSKNQFSLKLSSVTAADTAVYYCASIAVTGFYFDYWGQGTLVTVSSGGGGSGGGGSGGGGSEIVLTQSPGTLSLSPGERVTLSCRASQRVNNNYLAWYQQRPGQAPRLLIYGASSRATGIPDRFSGSGSGTDFTLTISRLEPEDFAVYYCQQYDRSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 225 - protein, 1093 aa, Artificial Sequence
  Synthetic peptide
QVQLQESGPGLVKPSETLSLTCTVSGGSISSYYWSWIRQPPGKGLEWIGYIYYSGRTNYYPSLKSRVTISIDTSKNQFSLKLSSVTAADTAVYYCARIAVAGFFFDYWGQGTLVTVSSGGGGSGGGGSGGGGSEIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 226 - protein, 1093 aa, Artificial Sequence
  Synthetic peptide
QVQLQESGPGLVKPSETLSLTCTVSGASISSFYWSWIRQPPGKGLEWIGYIYYSGTTNYNPSLKSRVTISVDTSKNQFSLKLSSVTAADTAVYYCARIAVAGFFFDYWGQGTLVTVSSGGGGSGGGGSGGGGSEIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 227 - protein, 1093 aa, Artificial Sequence
  Synthetic peptide
QVQLQESGPGLVKPSQTLSLTCTVSGASISSFYWSWIRQPPGKGLEWIGYIYYSGTTNYNPSLKSRVTISVDTSKNQFSLKLSSVTAADTAVYYCARIAVAGFFFDYWGQGTLVTVSSGGGGSGGGGSGGGGSEIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 228 - protein, 1093 aa, Artificial Sequence
  Synthetic peptide
QVQLQEWGPGLVKPSETLSLTCTVSGASISSFYWSWIRQPPGKGLEWIGYIYYSGTTNYNPSLKSRVTISVDTSKNQLSLKLSSVTAADTAVYYCARIAVAGFFFDYWGQGTLVTVSSGGGGSGGGGSGGGGSEIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 229 - protein, 1093 aa, Artificial Sequence
  Synthetic peptide
QVQLQESGPGLVKPSETLSLTCTVSGASISSFYWSWIRQPPGKGLEWIGYIYYSGTTNYNPSLKSRVTISVDTSKNQFSLKLSSVTAADTAVYYCARIAVAGFFFDYWGQGTLVTVSSGGGGSGGGGSGGGGSEIVLTQSPGTLSLSPGESATLSCRASQSVNKNYLAWYQQKPGQAPRLLIYGASSRATGIPDRFSGSGSGTDFTLTISRLEPEDFAVYYCQQYDRSPLTFGGGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 230 - protein, 1093 aa, Artificial Sequence
  Synthetic peptide
QVQLQESGPGLVKPSQTLSLTCTVSGGSISSYYWSWIRQPPGKGLEWIGYIFYNGITNYNPSLKSRVTISLDTSKNQFSLKLSSVTAADTAKYYCARIHSGSFSFDYWDQGTLVTVSSGGGGSGGGGSGGGGSEIVMTQSPGTLSLSPGERATLSCRASQSVSRGYLAWYQQKPGQAPRLLIYGASSRATDIPDRFSGSGSGTDFTLTISRLEPEDFAVYYCQQYDTSPITFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 231 - protein, 1100 aa, Artificial Sequence
  Synthetic peptide
EVQLVESGGGLVKPGGSLRLSCAASGFIFNNAGMSWVRQAPGKGLEWVGRIKNKIDGGTTDFAAPVKGRFTISRDDSKNTLYLQMNSLKAEDTAVYYCTARGWYGDYFDYWGQGTLVTVSSGGGGSGGGGSGGGGSDIVMTQTPLSLPVTPGEPASISCRSSQSLLHSNGYNYLDWYLQKPGQSPQLLIYLGSNRASGVPDRFSGSGSGTDFTLKISRVEAEDVGIYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 232 - protein, 1101 aa, Artificial Sequence
  Synthetic peptide
QVQLVESGGGVVQPGRSLRLSCAASGFSFSSYDIHWVRQAPGKGLEWVAVISSHGSNKNYARSVKGRFTISRDNSKNTLYLQMNSLKAEDTAVYYCARDGYSGNDPFYYYYHGMDVWGQGTTVTVSSGGGGSGGGGSGGGGSDIQMTQSPSSLSASVGDRVTITCRASQSISSYLNWYQQKPGKAPKLLIYAASSLQSGVPSRFSGSGSGTDFSLTISSLQPEDFATYYCQQSFTTPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 233 - protein, 1102 aa, Artificial Sequence
  Synthetic peptide
QVQLVQSGAEVKKPGASVKVSCKASGYTFTSYYMHWVRQAPGQGLEWMGIINPSDGSTNYAQNFQGRVTMTRDTSTNTVYMELSSLRSEDTAVYYCARGGNSAFYSYYDMDVWGQGTTVTVSSGGGGSGGGGSGGGGSDVVMTQSPLSLPVTLGQPASISCRSSQSLVYRDGNTYLSWFQQRPGQSPRRLIYKVSNWQSGVPDRFSGSGSGTDFTLKISRVEAEDVGVYFCMQGTHWPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 234 - protein, 1102 aa, Artificial Sequence
  Synthetic peptide
QVQLVQSGAEVKKPGASVKVSCKASGYTFTNYYMHWVRQAPGLGLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 235 - protein, 1102 aa, Artificial Sequence
  Synthetic peptide
QVQLVQSGAEVKKPGASVKVSCKASGYTFTGYYIHWVRQAPGQGLEWMGIINPSDGSTSYGQNFQGRVTMTRDTSTNTVYMELSSLRSEDTAVYYCARGGNSAFYSYYDMDVWGQGTTVTVSSGGGGSGGGGSGGGGSDVVMTQSPLSLPVTLGQPASISCRSSQSLAYRDGNTYLSWFQQRPGQSPRRLIYKVSNWQSGVPDRFSGSGSGTDFTLKISRVEAEDVGVYFCMQGTHWPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 236 - protein, 1102 aa, Artificial Sequence
  Synthetic peptide
QVQLVQSGAEVKKPGASVKVSCKASGYTFTGHYMHWVRQAPGQGLEWMGIINPSDGSTNYAQKFQGRVTMTRDTSTSTVYMELRSLRSEDTAVYYCTRGTTVVHYSYYDMDVWGQGTTVTVSSGGGGSGGGGSGGGGSDVVMTQTPLSLPVTLGQPASISCRSSQSLVYRDGNTYLTWFQQRPGQSPRRLIYKVSNWQSGVPDRFSGSGSGTDFTLKISRVEAEDVGVYYCMQGTHWPPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 237 - protein, 1102 aa, Artificial Sequence
  Synthetic peptide
QVQLVQSGAEVKKPGASVKVSCKASGYTFTNYFMHWVRQAPGLGLEWMGIINPSDGSTSYAQNFQGRVTMTRDTSTNTVYMELSSLRSEDTAVYYCARGGNSAFYSYYDMDVWGQGTTVTVSSGGGGSGGGGSGGGGSDVVMTQSPLSLPVTLGQPASISCRSSQSLVYRDGNTYLSWFQQRPGQSPRRLIYRVSNWQSGVPDRFSGSGSGTDFTLKISRVEAEDVGVYFCMQGTYWPPTFGQGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 238 - protein, 1097 aa, Artificial Sequence
  Synthetic peptide
QVQLVESGGGAVQPGRSLRLSCAASGFTFSNYGMHWVRQAPGKGLEWVAVISHHGSSKYYARSVKGRFTISRDNSKNTLYLEMNSLRAEDTAVYYCARDWWELVFDYWGQGTLVTVSSGGGGSGGGGSGGGGSDIVMTQTPLSLSVTPGQPASISCKSSQSLLHSDGKTFLYWYLQKPGQPPQLLIYEVSNRFSGVPDRFSGSGSGTDFTLKISRVEAEDVGVYYCLQGIHLPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 239 - protein, 1099 aa, Artificial Sequence
  Synthetic peptide
QVTLKESGPMLVKPTETLTLTCTVSGFSLSNSRMGVSWIRQPPGRALEWLAHIFSNDGKSYSTSLKSRLTISKDTSKSQVVLTMTNMDPVDTATYYCARYNYDSSGYYYSFFDYWGQGTLVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQGYSSPFTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 240 - protein, 1099 aa, Artificial Sequence
  Synthetic peptide
QVTLKESGPVLVKPTETLTLTCTVSGFSLSNARMGVSWLRQPPGKALEWLAHIFSTDEKSYSTSLKSRLTISKDTSKSQVVLTMTNMDPVDTATYYCARYYYDSSGYYYSFFDYWGQGTLVTVSSGGGGSGGGGSGGGGSDIQMTQSPSSLSASVGDRVTITCRASQSIRSYLNWYQQKPGKAPKLLIYGASNLQSGVPSRFSGSGSGTDFTLTISSLQPEDFATYYCQQSYSSPFTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 241 - protein, 1095 aa, Artificial Sequence
  Synthetic peptide
QVQLVQSGAEVKKPGASVKVSCKASGYAFTSYYIHWVRQAPGQGLEWMGIINPSGGSKSYAQKFRGRVTMTRDTSTSTVYMELSSLTSEDTAVYYCARSMSTVTSDAFDIWGQGTMVTVSSGGGGSGGGGSGGGGSDIQMTQSPSSLSASVGDRVTITCRASQSISNYLNWYQQKPGKAPKLLIYAASSLQSGVPSRFSGSGSGTEFTLTISSLQPEDFATYYCQQSYSAPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 242 - protein, 1093 aa, Artificial Sequence
  Synthetic peptide
QVQLQESGPGLVKPSETLSLTCTVSGGSISSYYWSWIRQPPGKGLEWIGYVYYSGTTNYNPSLKSRVTISVDTSKNQFSLKLSSVTAADTAVYYCASIAVTGFYFDYWGQGTLVTVSSGGGGSGGGGSGGGGSEIVLTQSPGTLSLSPGERVTLSCRASQRVNNNYLAWYQQRPGQAPRLLIYGASSRATGIPDRFSGSGSGTDFTLTISRLEPEDFAVYYCQQYDRSPLTFGGGTKLEIKSGGGGSEVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 243 - protein, 1093 aa, Artificial Sequence
  Synthetic peptide
QVQLQESGPGLVKPSETLSLTCTVSGGSISSYYWSWIRQPPGKGLEWIGYIYYSGRTNYYPSLKSRVTISIDTSKNQFSLKLSSVTAADTAVYYCARIAVAGFFFDYWGQGTLVTVSSGGGGSGGGGSGGGGSEIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGGGTKLEIKSGGGGSEVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 244 - protein, 1093 aa, Artificial Sequence
  Synthetic peptide
QVQLQESGPGLVKPSETLSLTCTVSGASISSFYWSWIRQPPGKGLEWIGYIYYSGTTNYNPSLKSRVTISVDTSKNQFSLKLSSVTAADTAVYYCARIAVAGFFFDYWGQGTLVTVSSGGGGSGGGGSGGGGSEIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGGGTKVEIKSGGGGSEVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 245 - protein, 1093 aa, Artificial Sequence
  Synthetic peptide
QVQLQESGPGLVKPSQTLSLTCTVSGASISSFYWSWIRQPPGKGLEWIGYIYYSGTTNYNPSLKSRVTISVDTSKNQFSLKLSSVTAADTAVYYCARIAVAGFFFDYWGQGTLVTVSSGGGGSGGGGSGGGGSEIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGGGTKVEIKSGGGGSEVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 246 - protein, 1093 aa, Artificial Sequence
  Synthetic peptide
QVQLQEWGPGLVKPSETLSLTCTVSGASISSFYWSWIRQPPGKGLEWIGYIYYSGTTNYNPSLKSRVTISVDTSKNQLSLKLSSVTAADTAVYYCARIAVAGFFFDYWGQGTLVTVSSGGGGSGGGGSGGGGSEIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGGGTKVDIKSGGGGSEVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 247 - protein, 1093 aa, Artificial Sequence
  Synthetic peptide
QVQLQESGPGLVKPSETLSLTCTVSGASISSFYWSWIRQPPGKGLEWIGYIYYSGTTNYNPSLKSRVTISVDTSKNQFSLKLSSVTAADTAVYYCARIAVAGFFFDYWGQGTLVTVSSGGGGSGGGGSGGGGSEIVLTQSPGTLSLSPGESATLSCRASQSVNKNYLAWYQQKPGQAPRLLIYGASSRATGIPDRFSGSGSGTDFTLTISRLEPEDFAVYYCQQYDRSPLTFGGGTRLEIKSGGGGSEVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 248 - protein, 1093 aa, Artificial Sequence
  Synthetic peptide
QVQLQESGPGLVKPSQTLSLTCTVSGGSISSYYWSWIRQPPGKGLEWIGYIFYNGITNYNPSLKSRVTISLDTSKNQFSLKLSSVTAADTAKYYCARIHSGSFSFDYWDQGTLVTVSSGGGGSGGGGSGGGGSEIVMTQSPGTLSLSPGERATLSCRASQSVSRGYLAWYQQKPGQAPRLLIYGASSRATDIPDRFSGSGSGTDFTLTISRLEPEDFAVYYCQQYDTSPITFGQGTKVEIKSGGGGSEVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 249 - protein, 1102 aa, Artificial Sequence
  Synthetic peptide
QVQLVQSGAEVKKPGASVKVSCKASGYTFTSYYMHWVRQAPGQGLEWMGIINPSDGSTNYAQNFQGRVTMTRDTSTNTVYMELSSLRSEDTAVYYCARGGNSAFYSYYDMDVWGQGTTVTVSSGGGGSGGGGSGGGGSDVVMTQSPLSLPVTLGQPASISCRSSQSLVYRDGNTYLSWFQQRPGQSPRRLIYKVSNWQSGVPDRFSGSGSGTDFTLKISRVEAEDVGVYFCMQGTHWPPTFGQGTKVEIKSGGGGSEVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 250 - protein, 1102 aa, Artificial Sequence
  Synthetic peptide
QVQLVQSGAEVKKPGASVKVSCKASGYTFTNYYMHWVRQAPGLGLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGQGTKVEIKSGGGGSEVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 251 - protein, 1102 aa, Homo sapiens
QVQLVQSGAEVKKPGASVKVSCKASGYTFTGYYIHWVRQAPGQGLEWMGIINPSDGSTSYGQNFQGRVTMTRDTSTNTVYMELSSLRSEDTAVYYCARGGNSAFYSYYDMDVWGQGTTVTVSSGGGGSGGGGSGGGGSDVVMTQSPLSLPVTLGQPASISCRSSQSLAYRDGNTYLSWFQQRPGQSPRRLIYKVSNWQSGVPDRFSGSGSGTDFTLKISRVEAEDVGVYFCMQGTHWPPTFGQGTKVEIKSGGGGSEVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 252 - protein, 618 aa, Homo sapiens
MVSPRMSGLLSQTVILALIFLPQTRPAGVFELQIHSFGPGPGPGAPRSPCSARLPCRLFFRVCLKPGLSEEAAESPCALGAALSARGPVYTEQPGAPAPDLPLPDGLLQVPFRDAWPGTFSFIIETWREELGDQIGGPAWSLLARVAGRRRLAAGGPWARDIQRAGAWELRFSYRARCEPPAVGTACTRLCRPRSAPSRCGPGLRPCAPLEDECEAPLVCRAGCSPEHGFCEQPGECRCLEGWTGPLCTVPVSTSSCLSPRGPSSATTGCLVPGPGPCDGNPCANGGSCSETPRSFECTCPRGFYGLRCEVSGVTCADGPCFNGGLCVGGADPDSAYICHCPPGFQGSNCEKRVDRCSLQPCRNGGLCLDLGHALRCRCRAGFAGPRCEHDLDDCAGRACANGGTCVEGGGAHRCSCALGFGGRDCRERADPCAARPCAHGGRCYAHFSGLVCACAPGYMGARCEFPVHPDGASALPAAPPGLRPGDPQRYLLPPALGLLVAAGVAGAALLLVHVRRRGHSQDAGSRLLAGTPEPSVHALPDALNNLRTQEGSGDGPSSSVDWNRPEDVDPQGIYVISAPSIYAREVATPLFPPLHTGRAGQRQHLLFPYPSSILSVK

SEQ ID NO: 253 - protein, 492 aa, Homo sapiens
MVSPRMSGLLSQTVILALIFLPQTRPAGVFELQIHSFGPGPGPGAPRSPCSARLPCRLFFRVCLKPGLSEEAAESPCALGAALSARGPVYTEQPGAPAPDLPLPDGLLQVPFRDAWPGTFSFIIETWREELGDQIGGPAWSLLARVAGRRRLAAGGPWARDIQRAGAWELRFSYRARCEPPAVGTACTRLCRPRSAPSRCGPGLRPCAPLEDECEAPLVCRAGCSPEHGFCEQPGECRCLEGWTGPLCTVPVSTSSCLSPRGPSSATTGCLVPGPGPCDGNPCANGGSCSETPRSFECTCPRGFYGLRCEVSGVTCADGPCFNGGLCVGGADPDSAYICHCPPGFQGSNCEKRVDRCSLQPCRNGGLCLDLGHALRCRCRAGFAGPRCEHDLDDCAGRACANGGTCVEGGGAHRCSCALGFGGRDCRERADPCAARPCAHGGRCYAHFSGLVCACAPGYMGARCEFPVHPDGASALPAAPPGLRPGDPQRYL

SEQ ID NO: 254 - protein, 175 aa, Homo sapiens
MVSPRMSGLLSQTVILALIFLPQTRPAGVFELQIHSFGPGPGPGAPRSPCSARLPCRLFFRVCLKPGLSEEAAESPCALGAALSARGPVYTEQPGAPAPDLPLPDGLLQVPFRDAWPGTFSFIIETWREELGDQIGGPAWSLLARVAGRRRLAAGGPWARDIQRAGAWELRFSYR

SEQ ID NO: 255 - protein, 40 aa, Homo sapiens
ARCEPPAVGTACTRLCRPRSAPSRCGPGLRPCAPLEDECE

SEQ ID NO: 256 - protein, 34 aa, Homo sapiens
APLVCRAGCSPEHGFCEQPGECRCLEGWTGPLCT

SEQ ID NO: 257 - protein, 37 aa, Homo sapiens
GPGPCDGNPCANGGSCSETPRSFECTCPRGFYGLRCE

SEQ ID NO: 258 - protein, 40 aa, Homo sapiens
SGVTCADGPCFNGGLCVGGADPDSAYICHCPPGFQGSNCE

SEQ ID NO: 259 - protein, 37 aa, Homo sapiens
RVDRCSLQPCRNGGLCLDLGHALRCRCRAGFAGPRCE

SEQ ID NO: 260 - protein, 78 aa, Homo sapiens
SGVTCADGPCFNGGLCVGGADPDSAYICHCPPGFQGSNCEKRVDRCSLQPCRNGGLCLDLGHALRCRCRAGFAGPRCE

SEQ ID NO: 261 - protein, 37 aa, Homo sapiens
DLDDCAGRACANGGTCVEGGGAHRCSCALGFGGRDCR

SEQ ID NO: 262 - protein, 37 aa, Homo sapiens
RADPCAARPCAHGGRCYAHFSGLVCACAPGYMGARCE

SEQ ID NO: 263 - protein, 548 aa, Artificial Sequence
  Synthetic peptide
MVSPRMSGLLSQTVILALIFLPQTRPAGVFELQIHSFGPGPGPGAPRSPCSARLPCRLFFRVCLKPGLSEEAAESPCALGAALSARGPVYTEQPGAPAPDLPLPDGLLQVPFRDAWPGTFSFIIETWREELGDQIGGPAWSLLARVAGRRRLAAGGPWARDIQRAGAWELRFSYRARCEPPAVGTACTRLCRPRSAPSRCGPGLRPCAPLEDECEAPLVCRAGCSPEHGFCEQPGECRCLEGWTGPLCTVPVSTSSCLSPRGPSSATTGCLVPGPGPCDGNPCANGGSCSETPRSFECTCPRGFYGLRCEVSGVTCADGPCFNGGLCVGGADPDSAYICHCPPGFQGSNCEKRVDRCSLQPCRNGGLCLDLGHALRCRCRAGFAGPRCEHDLDDCAGRACANGGTCVEGGGAHRCSCALGFGGRDCRERADPCAARPCAHGGRCYAHFSGLVCACAPGYMGARCEFPVHPDGASALPAAPPGLRPGDPQRYLSGGGGSGAGVIAVIVVVVIAIVAGIVVLVISRKKRMAKYEKAEIKEMGEMHRELNA

SEQ ID NO: 264 - protein, 408 aa, Artificial Sequence
  Synthetic peptide
MGWSCIILFLVATATGVHSGKPIPNPLLGLDSTSGARCEPPAVGTACTRLCRPRSAPSRCGPGLRPCAPLEDECEAPLVCRAGCSPEHGFCEQPGECRCLEGWTGPLCTVPVSTSSCLSPRGPSSATTGCLVPGPGPCDGNPCANGGSCSETPRSFECTCPRGFYGLRCEVSGVTCADGPCFNGGLCVGGADPDSAYICHCPPGFQGSNCEKRVDRCSLQPCRNGGLCLDLGHALRCRCRAGFAGPRCEHDLDDCAGRACANGGTCVEGGGAHRCSCALGFGGRDCRERADPCAARPCAHGGRCYAHFSGLVCACAPGYMGARCEFPVHPDGASALPAAPPGLRPGDPQRYLSGGGGSGAGVIAVIVVVVIAIVAGIVVLVISRKKRMAKYEKAEIKEMGEMHRELNA

SEQ ID NO: 265 - protein, 368 aa, Artificial Sequence
  Synthetic peptide
MGWSCIILFLVATATGVHSGKPIPNPLLGLDSTSGAPLVCRAGCSPEHGFCEQPGECRCLEGWTGPLCTVPVSTSSCLSPRGPSSATTGCLVPGPGPCDGNPCANGGSCSETPRSFECTCPRGFYGLRCEVSGVTCADGPCFNGGLCVGGADPDSAYICHCPPGFQGSNCEKRVDRCSLQPCRNGGLCLDLGHALRCRCRAGFAGPRCEHDLDDCAGRACANGGTCVEGGGAHRCSCALGFGGRDCRERADPCAARPCAHGGRCYAHFSGLVCACAPGYMGARCEFPVHPDGASALPAAPPGLRPGDPQRYLSGGGGSGAGVIAVIVVVVIAIVAGIVVLVISRKKRMAKYEKAEIKEMGEMHRELNA

SEQ ID NO: 266 - protein, 310 aa, Artificial Sequence
  Synthetic peptide
MGWSCIILFLVATATGVHSGKPIPNPLLGLDSTSGGPGPCDGNPCANGGSCSETPRSFECTCPRGFYGLRCEVSGVTCADGPCFNGGLCVGGADPDSAYICHCPPGFQGSNCEKRVDRCSLQPCRNGGLCLDLGHALRCRCRAGFAGPRCEHDLDDCAGRACANGGTCVEGGGAHRCSCALGFGGRDCRERADPCAARPCAHGGRCYAHFSGLVCACAPGYMGARCEFPVHPDGASALPAAPPGLRPGDPQRYLSGGGGSGAGVIAVIVVVVIAIVAGIVVLVISRKKRMAKYEKAEIKEMGEMHRELNA

SEQ ID NO: 267 - protein, 272 aa, Artificial Sequence
  Synthetic peptide
MGWSCIILFLVATATGVHSGKPIPNPLLGLDSTSGSGVTCADGPCFNGGLCVGGADPDSAYICHCPPGFQGSNCEKRVDRCSLQPCRNGGLCLDLGHALRCRCRAGFAGPRCEHDLDDCAGRACANGGTCVEGGGAHRCSCALGFGGRDCRERADPCAARPCAHGGRCYAHFSGLVCACAPGYMGARCEFPVHPDGASALPAAPPGLRPGDPQRYLSGGGGSGAGVIAVIVVVVIAIVAGIVVLVISRKKRMAKYEKAEIKEMGEMHRELNA

SEQ ID NO: 268 - protein, 231 aa, Artificial Sequence
  Synthetic peptide
MGWSCIILFLVATATGVHSGKPIPNPLLGLDSTSGRVDRCSLQPCRNGGLCLDLGHALRCRCRAGFAGPRCEHDLDDCAGRACANGGTCVEGGGAHRCSCALGFGGRDCRERADPCAARPCAHGGRCYAHFSGLVCACAPGYMGARCEFPVHPDGASALPAAPPGLRPGDPQRYLSGGGGSGAGVIAVIVVVVIAIVAGIVVLVISRKKRMAKYEKAEIKEMGEMHRELNA

SEQ ID NO: 269 - protein, 193 aa, Artificial Sequence
  Synthetic peptide
MGWSCIILFLVATATGVHSGKPIPNPLLGLDSTSGDLDDCAGRACANGGTCVEGGGAHRCSCALGFGGRDCRERADPCAARPCAHGGRCYAHFSGLVCACAPGYMGARCEFPVHPDGASALPAAPPGLRPGDPQRYLSGGGGSGAGVIAVIVVVVIAIVAGIVVLVISRKKRMAKYEKAEIKEMGEMHRELNA

SEQ ID NO: 270 - protein, 155 aa, Artificial Sequence
  Synthetic peptide
MGWSCIILFLVATATGVHSGKPIPNPLLGLDSTSGRADPCAARPCAHGGRCYAHFSGLVCACAPGYMGARCEFPVHPDGASALPAAPPGLRPGDPQRYLSGGGGSGAGVIAVIVVVVIAIVAGIVVLVISRKKRMAKYEKAEIKEMGEMHRELNA

SEQ ID NO: 271 - protein, 587 aa, Macaca fascicularis
MVSPRMSRLLSQTVILALIFIPQARPAGVFELQIHSFGPGPGPGAPRSPCSARGPCRLFFRVCLKPGLSEEAAESPCALGAALSARGPVYTEQPEAPAPDLPLPNGLLQVPFRDAWPGTFSLIIETWREELGDQIGGPAWSLLARVTRRRRLAAGGPWARDIQRAGAWELRFSYRARCELPAVGTACTRLCRPRSAPSRCGPGLRPCAPLEDECEAPPVCRAGCSLEHGFCEQPGECRCLEGWTGPLCMVPASTSSCLGLRGPSSATTGCLVPGPGPCDGNPCANGGSCSETPGSFECTCPRGFYGLRCEVSGVTCADGPCFNGGLCVGGADPDSAYICHCPPGFQGSNCEKRVDRCSLQPCRNGGLCLDLGHALRCRCRAGFAGPRCEHNLDDCAGRACANGGTCVEGGGAHRCSCALGFGGRDCRERADPCAARPCAHGGRCYAHFSGLVCACAPGYMGSRCEFPVHPDGVSALPAAPPGLRPGDPQRYLLPPALGLLVAAGVAGAALLLVHVRRRGHAQDAGSRLLAGTPEPSVHALPDALNNQRTQEGPGDVPSSSVDWNRPEDVDSRGIYVISAPSIYAREA

SEQ ID NO: 272 - protein, 492 aa, Macaca fascicularis
MVSPRMSRLLSQTVILALIFIPQARPAGVFELQIHSFGPGPGPGAPRSPCSARGPCRLFFRVCLKPGLSEEAAESPCALGAALSARGPVYTEQPEAPAPDLPLPNGLLQVPFRDAWPGTFSLIIETWREELGDQIGGPAWSLLARVTRRRRLAAGGPWARDIQRAGAWELRFSYRARCELPAVGTACTRLCRPRSAPSRCGPGLRPCAPLEDECEAPPVCRAGCSLEHGFCEQPGECRCLEGWTGPLCMVPASTSSCLGLRGPSSATTGCLVPGPGPCDGNPCANGGSCSETPGSFECTCPRGFYGLRCEVSGVTCADGPCFNGGLCVGGADPDSAYICHCPPGFQGSNCEKRVDRCSLQPCRNGGLCLDLGHALRCRCRAGFAGPRCEHNLDDCAGRACANGGTCVEGGGAHRCSCALGFGGRDCRERADPCAARPCAHGGRCYAHFSGLVCACAPGYMGSRCEFPVHPDGVSALPAAPPGLRPGDPQRYL

SEQ ID NO: 273 - protein, 175 aa, Macaca fascicularis
MVSPRMSRLLSQTVILALIFIPQARPAGVFELQIHSFGPGPGPGAPRSPCSARGPCRLFFRVCLKPGLSEEAAESPCALGAALSARGPVYTEQPEAPAPDLPLPNGLLQVPFRDAWPGTFSLIIETWREELGDQIGGPAWSLLARVTRRRRLAAGGPWARDIQRAGAWELRFSYR

SEQ ID NO: 274 - protein, 40 aa, Macaca fascicularis
ARCELPAVGTACTRLCRPRSAPSRCGPGLRPCAPLEDECE

SEQ ID NO: 275 - protein, 34 aa, Macaca fascicularis
APPVCRAGCSLEHGFCEQPGECRCLEGWTGPLCM

SEQ ID NO: 276 - protein, 37 aa, Macaca fascicularis
GPGPCDGNPCANGGSCSETPGSFECTCPRGFYGLRCE

SEQ ID NO: 277 - protein, 40 aa, Macaca fascicularis; identical to SEQ ID NO: 258

SEQ ID NO: 278 - protein, 37 aa, Macaca fascicularis; identical to SEQ ID NO: 259

SEQ ID NO: 279 - protein, 78 aa, Macaca fascicularis; identical to SEQ ID NO: 260

SEQ ID NO: 280 - protein, 37 aa, Macaca fascicularis
NLDDCAGRACANGGTCVEGGGAHRCSCALGFGGRDCR

SEQ ID NO: 281 - protein, 37 aa, Macaca fascicularis
RADPCAARPCAHGGRCYAHFSGLVCACAPGYMGSRCE

SEQ ID NO: 282 - protein, 548 aa, Artificial Sequence
  Synthetic peptide
MVSPRMSRLLSQTVILALIFIPQARPAGVFELQIHSFGPGPGPGAPRSPCSARGPCRLFFRVCLKPGLSEEAAESPCALGAALSARGPVYTEQPEAPAPDLPLPNGLLQVPFRDAWPGTFSLIIETWREELGDQIGGPAWSLLARVTRRRRLAAGGPWARDIQRAGAWELRFSYRARCELPAVGTACTRLCRPRSAPSRCGPGLRPCAPLEDECEAPPVCRAGCSLEHGFCEQPGECRCLEGWTGPLCMVPASTSSCLGLRGPSSATTGCLVPGPGPCDGNPCANGGSCSETPGSFECTCPRGFYGLRCEVSGVTCADGPCFNGGLCVGGADPDSAYICHCPPGFQGSNCEKRVDRCSLQPCRNGGLCLDLGHALRCRCRAGFAGPRCEHNLDDCAGRACANGGTCVEGGGAHRCSCALGFGGRDCRERADPCAARPCAHGGRCYAHFSGLVCACAPGYMGSRCEFPVHPDGVSALPAAPPGLRPGDPQRYLSGGGGSGAGVIAVIVVVVIAIVAGIVVLVISRKKRMAKYEKAEIKEMGEMHRELNA

SEQ ID NO: 283 - protein, 723 aa, Homo sapiens
MGSRCALALAVLSALLCQVWSSGVFELKLQEFVNKKGLLGNRNCCRGGAGPPPCACRTFFRVCLKHYQASVSPEPPCTYGSAVTPVLGVDSFSLPDGGGADSAFSNPIRFPFGFTWPGTFSLIIEALHTDSPDDLATENPERLISRLATQRHLTVGEEWSQDLHSSGRTDLKYSYRFVCDEHYYGEGCSVFCRPRDDAFGHFTCGERGEKVCNPGWKGPYCTEPICLPGCDEQHGFCDKPGECKCRVGWQGRYCDECIRYPGCLHGTCQQPWQCNCQEGWGGLFCNQDLNYCTHHKPCKNGATCTNTGQGSYTCSCRPGYTGATCELGIDECDPSPCKNGGSCTDLENSYSCTCPPGFYGKICELSAMTCADGPCFNGGRCSDSPDGGYSCRCPVGYSGFNCEKKIDYCSSSPCSNGAKCVDLGDAYLCRCQAGFSGRHCDDNVDDCASSPCANGGTCRDGVNDFSCTCPPGYTGRNCSAPVSRCEHAPCHNGATCHERGHRYVCECARGYGGPNCQFLLPELPPGPAVVDLTEKLEGQGGPFPWVAVCAGVILVLMLLLGCAAVVVCVRLRLQKHRPPADPCRGETETMNNLANCQREKDISVSIIGATQIKNTNKKADFHGDHSADKNGFKARYPAVDYNLVQDLKGDDTAVRDAHSKRDTKCQPQGSSGEEKGTPTTLRGGEASERKRPDSGCSTSKDTKYQSVYVISEEKDECVIATEV

SEQ ID NO: 284 - protein, 685 aa, Homo sapiens
MAAASRSASGWALLLLVALWQQRAAGSGVFQLQLQEFINERGVLASGRPCEPGCRTFFRVCLKHFQAVVSPGPCTFGTVSTPVLGTNSFAVRDDSSGGGRNPLQLPFNFTWPGTFSLIIEAWHAPGDDLRPEALPPDALISKIAIQGSLAVGQNWLLDEQTSTLTRLRYSYRVICSDNYYGDNCSRLCKKRNDHFGHYVCQPDGNLSCLPGWTGEYCQQPICLSGCHEQNGYCSKPAECLCRPGWQGRLCNECIPHNGCRHGTCSTPWQCTCDEGWGGLFCDQDLNYCTHHSPCKNGATCSNSGQRSYTCTCRPGYTGVDCELELSECDSNPCRNGGSCKDQEDGYHCLCPPGYYGLHCEHSTLSCADSPCFNGGSCRERNQGANYACECPPNFTGSNCEKKVDRCTSNPCANGGQCLNRGPSRMCRCRPGFTGTYCELHVSDCARNPCAHGGTCHDLENGLMCTCPAGFSGRRCEVRTSIDACASSPCFNRATCYTDLSTDTFVCNCPYGFVGSRCEFPVGLPPSFPWVAVSLGVGLAVLLVLLGMVAVAVRQLRLRRPDDGSREAMNNLSDFQKDNLIPAAQLKNTNQKKELEVDCGLDKSNCGKQQNHTLDYNLAPGPLGRGTMPGKFPHSDKSLGEKAPLRLHSEKPECRISAICSPRDSMYQSVCLISEERNECVIATEV

SEQ ID NO: 285 - protein, 4 aa, Artificial Sequence
  Synthetic peptide
GGGG

SEQ ID NO: 286 - protein, 5 aa, Artificial Sequence
  Synthetic peptide
GGGGS

SEQ ID NO: 287 - protein, 5 aa, Artificial Sequence
  Synthetic peptide
GGGGQ

SEQ ID NO: 288 - protein, 6 aa, Artificial Sequence
  Synthetic peptide
SGGGGS

SEQ ID NO: 289 - protein, 6 aa, Artificial Sequence
  Synthetic peptide
PGGGGS

SEQ ID NO: 290 - protein, 6 aa, Artificial Sequence
  Synthetic peptide
PGGDGS

SEQ ID NO: 291 - protein, 9 aa, Artificial Sequence
  Synthetic peptide
GGGGSGGGS

SEQ ID NO: 292 - protein, 10 aa, Artificial Sequence
  Synthetic peptide
GGGGSGGGGS

SEQ ID NO: 293 - protein, 15 aa, Artificial Sequence
  Synthetic peptide
GGGGSGGGGSGGGGS

SEQ ID NO: 294 - protein, 6 aa, Artificial Sequence
  Synthetic peptide
HHHHHH

SEQ ID NO: 295 - protein, 16 aa, Artificial Sequence
  Synthetic peptide
RDWDFDVFGGGTPVGG

SEQ ID NO: 296 - protein, 16 aa, Artificial Sequence
  Synthetic peptide
  misc_feature (12)..(12): Xaa can be any naturally occurring amino acid
QRFVTGHFGGLXPANG

SEQ ID NO: 297 - protein, 16 aa, Artificial Sequence
  Synthetic peptide
QRFVTGHFGGLYPANG

SEQ ID NO: 298 - protein, 16 aa, Artificial Sequence
  Synthetic peptide
QRFVTGHFGGLHPANG

SEQ ID NO: 299 - protein, 9 aa, Artificial Sequence
  Synthetic peptide
TGHFGGLHP

SEQ ID NO: 300 - protein, 16 aa, Artificial Sequence
  Synthetic peptide
QRFCTGHFGGLHPCNG

SEQ ID NO: 301 - protein, 585 aa, Homo sapiens [sequence omitted]

SEQ ID NO: 302 - protein, 585 aa, Artificial Sequence
  Synthetic peptide
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGL

SEQ ID NO: 303 - protein, 585 aa, Artificial Sequence
  Synthetic peptide
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGL

SEQ ID NO: 304 - protein, 585 aa, Artificial Sequence
  Synthetic peptide
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGL

SEQ ID NO: 305 - protein, 585 aa, Artificial Sequence
  Synthetic peptide
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGL

SEQ ID NO: 306 - protein, 585 aa, Artificial Sequence
  Synthetic peptide
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGL

SEQ ID NO: 307 - protein, 585 aa, Artificial Sequence
  Synthetic peptide
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGL

SEQ ID NO: 308 - protein, 585 aa, Artificial Sequence
  Synthetic peptide
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGL

SEQ ID NO: 309 - protein, 585 aa, Artificial Sequence
  Synthetic peptide
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGL

SEQ ID NO: 310 - protein, 585 aa, Artificial Sequence
  Synthetic peptide
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPKLVAASKAALGL

SEQ ID NO: 311 - protein, 585 aa, Artificial Sequence
  Synthetic peptide
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 312 - protein, 585 aa, Artificial Sequence
  Synthetic peptide
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGL

SEQ ID NO: 313 - protein, 585 aa, Artificial Sequence
  Synthetic peptide
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGL

SEQ ID NO: 314 - protein, 585 aa, Artificial Sequence
  Synthetic peptide
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGL

SEQ ID NO: 315 - protein, 585 aa, Artificial Sequence
  Synthetic peptide
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGL

SEQ ID NO: 316 - protein, 585 aa, Artificial Sequence
  Synthetic peptide
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGL

SEQ ID NO: 317 - protein, 585 aa, Artificial Sequence
  Synthetic peptide
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGL

SEQ ID NO: 318 - protein, 585 aa, Artificial Sequence
  Synthetic peptide
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGL

SEQ ID NO: 319 - protein, 585 aa, Artificial Sequence
  Synthetic peptide
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGL

SEQ ID NO: 320 - protein, 585 aa, Artificial Sequence
  Synthetic peptide
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPKLVAASKAALGL

SEQ ID NO: 321 - protein, 585 aa, Artificial Sequence
  Synthetic peptide
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 322 - protein, 585 aa, Artificial Sequence
  Synthetic peptide
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGL

SEQ ID NO: 323 - protein, 585 aa, Artificial Sequence
  Synthetic peptide
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGL

SEQ ID NO: 324 - protein, 585 aa, Artificial Sequence
  Synthetic peptide
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGL

SEQ ID NO: 325 - protein, 585 aa, Artificial Sequence
  Synthetic peptide
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGL

SEQ ID NO: 326 - protein, 585 aa, Artificial Sequence
  Synthetic peptide
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGL

SEQ ID NO: 327 - protein, 585 aa, Artificial Sequence
  Synthetic peptide
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGL

SEQ ID NO: 328 - protein, 585 aa, Artificial Sequence
  Synthetic peptide
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGL

SEQ ID NO: 329 - protein, 585 aa, Artificial Sequence
  Synthetic peptide
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGL

SEQ ID NO: 330 - protein, 585 aa, Artificial Sequence
  Synthetic peptide
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPKLVAASKAALGL

SEQ ID NO: 331 - protein, 330 aa, Artificial Sequence
  Synthetic peptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 332 - protein, 333 aa, Artificial Sequence
  Synthetic peptide
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 333 - protein, 330 aa, Artificial Sequence
  Synthetic peptide
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 334 - protein, 338 aa, Artificial Sequence
  Synthetic peptide
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECSEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 335 - protein, 227 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 336 - protein, 227 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 337 - protein, 232 aa, Artificial Sequence
  Synthetic peptide
EPKSSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 338 - protein, 232 aa, Artificial Sequence
  Synthetic peptide
EPKSSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 339 - protein, 232 aa, Artificial Sequence
  Synthetic peptide
EPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 340 - protein, 232 aa, Artificial Sequence
  Synthetic peptide
EPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 341 - protein, 217 aa, Artificial Sequence
  Synthetic peptide
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVTTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 342 - protein, 14 aa, Artificial Sequence
  Synthetic peptide
GSSTGAVTSGYYPN

SEQ ID NO: 343 - protein, 7 aa, Artificial Sequence
  Synthetic peptide
GTKFLAP

SEQ ID NO: 344 - protein, 9 aa, Artificial Sequence
  Synthetic peptide
ALWYSNRWV

SEQ ID NO: 345 - protein, 5 aa, Artificial Sequence
  Synthetic peptide
IYAMN

SEQ ID NO: 346 - protein, 19 aa, Artificial Sequence
  Synthetic peptide
RIRSKYNNYATYYADSVKS

SEQ ID NO: 347 - protein, 14 aa, Artificial Sequence
  Synthetic peptide
HGNFGNSYVSFFAY

SEQ ID NO: 348 - protein, 125 aa, Artificial Sequence
  Synthetic peptide
EVQLVESGGGLVQPGGSLKLSCAASGFTFNIYAMNWVRQAPGKGLEWVARIRSKYNNYATYYADSVKSRFTISRDDSKNTAYLQMNNLKTEDTAVYYCVRHGNFGNSYVSFFAYWGQGTLVTVSS

SEQ ID NO: 349 - protein, 109 aa, Artificial Sequence
  Synthetic peptide
QTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 350 - protein, 249 aa, Artificial Sequence
  Synthetic peptide
EVQLVESGGGLVQPGGSLKLSCAASGFTFNIYAMNWVRQAPGKGLEWVARIRSKYNNYATYYADSVKSRFTISRDDSKNTAYLQMNNLKTEDTAVYYCVRHGNFGNSYVSFFAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 351 - protein, 14 aa, Artificial Sequence
  Synthetic peptide
GSSTGAVTSGYYPN

SEQ ID NO: 352 - protein, 7 aa, Artificial Sequence
  Synthetic peptide
GTKFLAP

SEQ ID NO: 353 - protein, 9 aa, Artificial Sequence
  Synthetic peptide
ALWYSNRWV

SEQ ID NO: 354 - protein, 5 aa, Artificial Sequence
  Synthetic peptide
KYAMN

SEQ ID NO: 355 - protein, 19 aa, Artificial Sequence
  Synthetic peptide
RIRSKYNNYATYYADSVKD

SEQ ID NO: 356 - protein, 14 aa, Artificial Sequence
  Synthetic peptide
HGNFGNSYISYWAY

SEQ ID NO: 357 - protein, 125 aa, Artificial Sequence
  Synthetic peptide
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSS

SEQ ID NO: 358 - protein, 109 aa, Artificial Sequence; identical to SEQ ID NO: 349
  Synthetic peptide

SEQ ID NO: 359 - protein, 249 aa, Artificial Sequence
  Synthetic peptide
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 360 - protein, 14 aa, Artificial Sequence
  Synthetic peptide
GSSTGAVTSGYYPN

SEQ ID NO: 361 - protein, 7 aa, Artificial Sequence
  Synthetic peptide
GTKFLAP

SEQ ID NO: 362 - protein, 9 aa, Artificial Sequence
  Synthetic peptide
ALWYSNRWV

SEQ ID NO: 363 - protein, 5 aa, Artificial Sequence
  Synthetic peptide
SYAMN

SEQ ID NO: 364 - protein, 19 aa, Artificial Sequence
  Synthetic peptide
RIRSKYNNYATYYADSVKG

SEQ ID NO: 365 - protein, 14 aa, Artificial Sequence
  Synthetic peptide
HGNFGNSYLSFWAY

SEQ ID NO: 366 - protein, 125 aa, Artificial Sequence
  Synthetic peptide
EVQLVESGGGLEQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYLSFWAYWGQGTLVTVSS

SEQ ID NO: 367 - protein, 109 aa, Artificial Sequence; identical to SEQ ID NO: 349
  Synthetic peptide

SEQ ID NO: 368 - protein, 249 aa, Artificial Sequence
  Synthetic peptide
EVQLVESGGGLEQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYLSFWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 369 - protein, 14 aa, Artificial Sequence
  Synthetic peptide
GSSTGAVTSGYYPN

SEQ ID NO: 370 - protein, 7 aa, Artificial Sequence
  Synthetic peptide
GTKFLAP

SEQ ID NO: 371 - protein, 9 aa, Artificial Sequence
  Synthetic peptide
ALWYSNRWV

SEQ ID NO: 372 - protein, 5 aa, Artificial Sequence
  Synthetic peptide
RYAMN

SEQ ID NO: 373 - protein, 19 aa, Artificial Sequence
  Synthetic peptide
RIRSKYNNYATYYADSVKG

SEQ ID NO: 374 - protein, 14 aa, Artificial Sequence
  Synthetic peptide
HGNFGNSYLSYFAY

SEQ ID NO: 375 - protein, 125 aa, Artificial Sequence
  Synthetic peptide
EVQLVESGGGLVQPGGSLKLSCAASGFTFNRYAMNWVRQAPGKGLEWVARIRSKYNNYATYYADSVKGRFTISRDDSKNTAYLQMNNLKTEDTAVYYCVRHGNFGNSYLSYFAYWGQGTLVTVSS

SEQ ID NO: 376 - protein, 109 aa, Artificial Sequence; identical to SEQ ID NO: 349
  Synthetic peptide

SEQ ID NO: 377 - protein, 249 aa, Artificial Sequence
  Synthetic peptide
EVQLVESGGGLVQPGGSLKLSCAASGFTFNRYAMNWVRQAPGKGLEWVARIRSKYNNYATYYADSVKGRFTISRDDSKNTAYLQMNNLKTEDTAVYYCVRHGNFGNSYLSYFAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 378 - protein, 14 aa, Artificial Sequence
  Synthetic peptide
RSSTGAVTSGYYPN

SEQ ID NO: 379 - protein, 7 aa, Artificial Sequence
  Synthetic peptide
ATDMRPS

SEQ ID NO: 380 - protein, 9 aa, Artificial Sequence
  Synthetic peptide
ALWYSNRWV

SEQ ID NO: 381 - protein, 5 aa, Artificial Sequence
  Synthetic peptide
VYAMN

SEQ ID NO: 382 - protein, 19 aa, Artificial Sequence
  Synthetic peptide
RIRSKYNNYATYYADSVKK

SEQ ID NO: 383 - protein, 14 aa, Artificial Sequence
  Synthetic peptide
HGNFGNSYLSWWAY

SEQ ID NO: 384 - protein, 125 aa, Artificial Sequence
  Synthetic peptide
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYLSWWAYWGQGTLVTVSS

SEQ ID NO: 385 - protein, 109 aa, Artificial Sequence
  Synthetic peptide
QTVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 386 - protein, 249 aa, Artificial Sequence
  Synthetic peptide
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYLSWWAYWGQGTLVTVSSGGGGSGGGGSGGGGSQTVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 387 - protein, 14 aa, Artificial Sequence
  Synthetic peptide
GSSTGAVTSGYYPN

SEQ ID NO: 388 - protein, 7 aa, Artificial Sequence
  Synthetic peptide
GTKFLAP

SEQ ID NO: 389 - protein, 9 aa, Artificial Sequence
  Synthetic peptide
ALWYSNRWV

SEQ ID NO: 390 - protein, 5 aa, Artificial Sequence
  Synthetic peptide
KYAMN

SEQ ID NO: 391 - protein, 19 aa, Artificial Sequence
  Synthetic peptide
RIRSKYNNYATYYADSVKS

SEQ ID NO: 392 - protein, 14 aa, Artificial Sequence
  Synthetic peptide
HGNFGNSYTSYYAY

SEQ ID NO: 393 - protein, 125 aa, Artificial Sequence
  Synthetic peptide
EVQLVESGGGLVQPGGSLKLSCAASGFTFNKYAMNWVRQAPGKGLEWVARIRSKYNNYATYYADSVKSRFTISRDDSKNTAYLQMNNLKTEDTAVYYCVRHGNFGNSYTSYYAYWGQGTLVTVSS

SEQ ID NO: 394 - protein, 109 aa, Artificial Sequence; identical to SEQ ID NO: 349
  Synthetic peptide

SEQ ID NO: 395 - protein, 249 aa, Artificial Sequence
  Synthetic peptide
EVQLVESGGGLVQPGGSLKLSCAASGFTFNKYAMNWVRQAPGKGLEWVARIRSKYNNYATYYADSVKSRFTISRDDSKNTAYLQMNNLKTEDTAVYYCVRHGNFGNSYTSYYAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 396 - protein, 14 aa, Artificial Sequence
  Synthetic peptide
RSSTGAVTSGYYPN

SEQ ID NO: 397 - protein, 7 aa, Artificial Sequence
  Synthetic peptide
ATDMRPS

SEQ ID NO: 398 - protein, 9 aa, Artificial Sequence
  Synthetic peptide
ALWYSNRWV

SEQ ID NO: 399 - protein, 5 aa, Artificial Sequence
  Synthetic peptide
GYAMN

SEQ ID NO: 400 - protein, 19 aa, Artificial Sequence
  Synthetic peptide
RIRSKYNNYATYYADSVKE

SEQ ID NO: 401 - protein, 14 aa, Artificial Sequence
  Synthetic peptide
HRNFGNSYLSWFAY

SEQ ID NO: 402 - protein, 125 aa, Artificial Sequence
  Synthetic peptide
EVQLVESGGGLVQPGGSLKLSCAASGFTFNGYAMNWVRQAPGKGLEWVARIRSKYNNYATYYADSVKERFTISRDDSKNTAYLQMNNLKTEDTAVYYCVRHRNFGNSYLSWFAYWGQGTLVTVSS

SEQ ID NO: 403 - protein, 109 aa, Artificial Sequence; identical to SEQ ID NO: 385
  Synthetic peptide

SEQ ID NO: 404 - protein, 249 aa, Artificial Sequence
  Synthetic peptide
EVQLVESGGGLVQPGGSLKLSCAASGFTFNGYAMNWVRQAPGKGLEWVARIRSKYNNYATYYADSVKERFTISRDDSKNTAYLQMNNLKTEDTAVYYCVRHRNFGNSYLSWFAYWGQGTLVTVSSGGGGSGGGGSGGGGSQTVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 405 - protein, 14 aa, Artificial Sequence
  Synthetic peptide
GSSTGAVTSGYYPN

SEQ ID NO: 406 - protein, 7 aa, Artificial Sequence
  Synthetic peptide
GTKFLAP

SEQ ID NO: 407 - protein, 9 aa, Artificial Sequence
  Synthetic peptide
ALWYSNRWV

SEQ ID NO: 408 - protein, 5 aa, Artificial Sequence
  Synthetic peptide
VYAMN

SEQ ID NO: 409 - protein, 19 aa, Artificial Sequence
  Synthetic peptide
RIRSKYNNYATYYADSVKK

SEQ ID NO: 410 - protein, 14 aa, Artificial Sequence
  Synthetic peptide
HGNFGNSYISWWAY

SEQ ID NO: 411 - protein, 125 aa, Artificial Sequence
  Synthetic peptide
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYISWWAYWGQGTLVTVSS

SEQ ID NO: 412 - protein, 109 aa, Artificial Sequence; identical to SEQ ID NO: 349
  Synthetic peptide

SEQ ID NO: 413 - protein, 249 aa, Artificial Sequence
  Synthetic peptide
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYISWWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 414 - protein, 14 aa, Artificial Sequence
  Synthetic peptide
GSSTGAVTSGNYPN

SEQ ID NO: 415 - protein, 7 aa, Artificial Sequence
  Synthetic peptide
GTKFLAP

SEQ ID NO: 416 - protein, 9 aa, Artificial Sequence
  Synthetic peptide
VLWYSNRWV

SEQ ID NO: 417 - protein, 5 aa, Artificial Sequence
  Synthetic peptide
SYAMN

SEQ ID NO: 418 - protein, 19 aa, Artificial Sequence
  Synthetic peptide
RIRSKYNNYATYYADSVKG

SEQ ID NO: 419 - protein, 14 aa, Artificial Sequence
  Synthetic peptide
HGNFGNSYVSWWAY

SEQ ID NO: 420 - protein, 125 aa, Artificial Sequence
  Synthetic peptide
EVQLVESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSS

SEQ ID NO: 421 - protein, 109 aa, Artificial Sequence
  Synthetic peptide
QTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 422 - protein, 249 aa, Artificial Sequence
  Synthetic peptide
EVQLVESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 423 - protein, 14 aa, Artificial Sequence
  Synthetic peptide
GSSTGAVTSGNYPN

SEQ ID NO: 424 - protein, 7 aa, Artificial Sequence
  Synthetic peptide
GTKFLAP

SEQ ID NO: 425 - protein, 9 aa, Artificial Sequence
  Synthetic peptide
VLWYSNRWV

SEQ ID NO: 426 - protein, 5 aa, Artificial Sequence
  Synthetic peptide
KYAMN

SEQ ID NO: 427 - protein, 19 aa, Artificial Sequence
  Synthetic peptide
RIRSKYNNYATYYADSVKD

SEQ ID NO: 428 - protein, 14 aa, Artificial Sequence
  Synthetic peptide
HGNFGNSYISYWAY

SEQ ID NO: 429 - protein, 125 aa, Artificial Sequence; identical to SEQ ID NO: 357
  Synthetic peptide

SEQ ID NO: 430 - protein, 109 aa, Artificial Sequence; identical to SEQ ID NO: 421
  Synthetic peptide

SEQ ID NO: 431 - protein, 249 aa, Artificial Sequence
  Synthetic peptide
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 432 - protein, 125 aa, Artificial Sequence
  Synthetic peptide
EVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSS

SEQ ID NO: 433 - protein, 109 aa, Artificial Sequence; identical to SEQ ID NO: 421
  Synthetic peptide

SEQ ID NO: 434 - protein, 249 aa, Artificial Sequence
  Synthetic peptide
EVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 435 - protein, 118 aa, Artificial Sequence
  Synthetic peptide
QVQLQESGPGLVKPSETLSLTCTVSGGSISSYYWSWIRQPPGKCLEWIGYVYYSGTTNYNPSLKSRVTISVDTSKNQFSLKLSSVTAADTAVYYCASIAVTGFYFDYWGQGTLVTVSS

SEQ ID NO: 436 - protein, 108 aa, Artificial Sequence
  Synthetic peptide
EIVLTQSPGTLSLSPGERVTLSCRASQRVNNNYLAWYQQRPGQAPRLLIYGASSRATGIPDRFSGSGSGTDFTLTISRLEPEDFAVYYCQQYDRSPLTFGCGTKLEIK

SEQ ID NO: 437 - protein, 241 aa, Artificial Sequence
  Synthetic peptide
QVQLQESGPGLVKPSETLSLTCTVSGGSISSYYWSWIRQPPGKCLEWIGYVYYSGTTNYNPSLKSRVTISVDTSKNQFSLKLSSVTAADTAVYYCASIAVTGFYFDYWGQGTLVTVSSGGGGSGGGGSGGGGSEIVLTQSPGTLSLSPGERVTLSCRASQRVNNNYLAWYQQRPGQAPRLLIYGASSRATGIPDRFSGSGSGTDFTLTISRLEPEDFAVYYCQQYDRSPLTFGCGTKLEIK

SEQ ID NO: 438 - protein, 496 aa, Artificial Sequence
  Synthetic peptide
QVQLQESGPGLVKPSETLSLTCTVSGGSISSYYWSWIRQPPGKCLEWIGYVYYSGTTNYNPSLKSRVTISVDTSKNQFSLKLSSVTAADTAVYYCASIAVTGFYFDYWGQGTLVTVSSGGGGSGGGGSGGGGSEIVLTQSPGTLSLSPGERVTLSCRASQRVNNNYLAWYQQRPGQAPRLLIYGASSRATGIPDRFSGSGSGTDFTLTISRLEPEDFAVYYCQQYDRSPLTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 439 - protein, 17 aa, Artificial Sequence
  Synthetic peptide
IINPSEGSTSYAQKFQG

SEQ ID NO: 440 - protein, 17 aa, Artificial Sequence
  Synthetic peptide
IINPSDASTSYAQKFQG

SEQ ID NO: 441 - protein, 16 aa, Artificial Sequence
  Synthetic peptide
RSSQSLVYREGNTYLS

SEQ ID NO: 442 - protein, 16 aa, Artificial Sequence
  Synthetic peptide
RSSQSLVYRDANTYLS

SEQ ID NO: 443 - protein, 16 aa, Artificial Sequence
  Synthetic peptide
RSSQSLVYRDGQTYLS

SEQ ID NO: 444 - protein, 16 aa, Artificial Sequence
  Synthetic peptide
RSSQSLVYRDGNAYLS

SEQ ID NO: 445 - protein, 123 aa, Artificial Sequence
  Synthetic peptide
QVQLVQSGAEVKKPGASVKVSCKASGYTFTNYYMHWVRQAPGQGLEWMGIINPSDGSTSYAQKFQGRVTMTRDTSTNTVYMDLSSLRSEDTAVYYCARGGNSAFYSYYDMDVWGQGTTVTVSS

SEQ ID NO: 446 - protein, 123 aa, Artificial Sequence
  Synthetic peptide
QVQLVQSGAEVKKPGASVKVSCKASGYTFTNYYMHWVRQAPGLGLEWMGIINPSEGSTSYAQKFQGRVTMTRDTSTNTVYMDLSSLRSEDTAVYYCARGGNSAFYSYYDMDVWGQGTTVTVSS

SEQ ID NO: 447 - protein, 123 aa, Artificial Sequence
  Synthetic peptide
QVQLVQSGAEVKKPGASVKVSCKASGYTFTNYYMHWVRQAPGLGLEWMGIINPSDASTSYAQKFQGRVTMTRDTSTNTVYMDLSSLRSEDTAVYYCARGGNSAFYSYYDMDVWGQGTTVTVSS

SEQ ID NO: 448 - protein, 123 aa, Artificial Sequence
  Synthetic peptide
QVQLVQSGAEVKKPGASVKVSCKASGYTFTNYYMHWVRQAPGQGLEWMGIINPSEGSTSYAQKFQGRVTMTRDTSTNTVYMDLSSLRSEDTAVYYCARGGNSAFYSYYDMDVWGQGTTVTVSS

SEQ ID NO: 449 - protein, 122 aa, Artificial Sequence
  Synthetic peptide
QVQLVQSGAEVKKPGASVKVSCKASGYTFTNYYMHWVRQAPGQGLEWMGIINPSDASTSYAQKFQGRVTMTRDTSTNTVYMDLSSLRSEDTAVYYCARGGNSAFYSYYDMDVWGQGTTVTVS

SEQ ID NO: 450 - protein, 123 aa, Artificial Sequence
  Synthetic peptide
QVQLVQSGAEVKKPGASVKVSCKASGYTFTNYYMHWVRQAPGLCLEWMGIINPSDGSTSYAQKFQGRVTMTRDTSTNTVYMDLSSLRSEDTAVYYCARGGNSAFYSYYDMDVWGQGTTVTVSS

SEQ ID NO: 451 - protein, 123 aa, Artificial Sequence
  Synthetic peptide
QVQLVQSGAEVKKPGASVKVSCKASGYTFTNYYMHWVRQAPGQCLEWMGIINPSDGSTSYAQKFQGRVTMTRDTSTNTVYMDLSSLRSEDTAVYYCARGGNSAFYSYYDMDVWGQGTTVTVSS

SEQ ID NO: 452 - protein, 123 aa, Artificial Sequence
  Synthetic peptide
QVQLVQSGAEVKKPGASVKVSCKASGYTFTNYYMHWVRQAPGLCLEWMGIINPSEGSTSYAQKFQGRVTMTRDTSTNTVYMDLSSLRSEDTAVYYCARGGNSAFYSYYDMDVWGQGTTVTVSS

SEQ ID NO: 453 - protein, 123 aa, Artificial Sequence
  Synthetic peptide
QVQLVQSGAEVKKPGASVKVSCKASGYTFTNYYMHWVRQAPGLCLEWMGIINPSDASTSYAQKFQGRVTMTRDTSTNTVYMDLSSLRSEDTAVYYCARGGNSAFYSYYDMDVWGQGTTVTVSS

SEQ ID NO: 454 - protein, 123 aa, Artificial Sequence
  Synthetic peptide
QVQLVQSGAEVKKPGASVKVSCKASGYTFTNYYMHWVRQAPGQCLEWMGIINPSEGSTSYAQKFQGRVTMTRDTSTNTVYMDLSSLRSEDTAVYYCARGGNSAFYSYYDMDVWGQGTTVTVSS

SEQ ID NO: 455 - protein, 123 aa, Artificial Sequence
  Synthetic peptide
QVQLVQSGAEVKKPGASVKVSCKASGYTFTNYYMHWVRQAPGQCLEWMGIINPSDASTSYAQKFQGRVTMTRDTSTNTVYMDLSSLRSEDTAVYYCARGGNSAFYSYYDMDVWGQGTTVTVSS

SEQ ID NO: 456 - protein, 112 aa, Artificial Sequence
  Synthetic peptide
DVVMTQTPLSLPVTLGQPASISCRSSQSLVYREGNTYLSWFQQRPGQSPRRLIYKVSNWQSGVPDRFSGGGSGTDFTLKISRVEAEDVGVYYCMQGTHWPPTFGQGTKVEIK

SEQ ID NO: 457 - protein, 112 aa, Artificial Sequence
  Synthetic peptide
DVVMTQTPLSLPVTLGQPASISCRSSQSLVYRDANTYLSWFQQRPGQSPRRLIYKVSNWQSGVPDRFSGGGSGTDFTLKISRVEAEDVGVYYCMQGTHWPPTFGQGTKVEIK

SEQ ID NO: 458 - protein, 112 aa, Artificial Sequence
  Synthetic peptide
DVVMTQTPLSLPVTLGQPASISCRSSQSLVYRDGQTYLSWFQQRPGQSPRRLIYKVSNWQSGVPDRFSGGGSGTDFTLKISRVEAEDVGVYYCMQGTHWPPTFGQGTKVEIK

SEQ ID NO: 459 - protein, 112 aa, Artificial Sequence
  Synthetic peptide
DVVMTQTPLSLPVTLGQPASISCRSSQSLVYRDGNAYLSWFQQRPGQSPRRLIYKVSNWQSGVPDRFSGGGSGTDFTLKISRVEAEDVGVYYCMQGTHWPPTFGQGTKVEIK

SEQ ID NO: 460 - protein, 112 aa, Artificial Sequence
  Synthetic peptide
DVVMTQTPLSLPVTLGQPASISCRSSQSLVYRDGNTYLSWFQQRPGQSPRRLIYKVSNWQSGVPDRFSGSGSGTDFTLKISRVEAEDVGVYYCMQGTHWPPTFGQGTKVEIK

SEQ ID NO: 461 - protein, 112 aa, Artificial Sequence
  Synthetic peptide
DVVMTQTPLSLPVTLGQPASISCRSSQSLVYREGNTYLSWFQQRPGQSPRRLIYKVSNWQSGVPDRFSGSGSGTDFTLKISRVEAEDVGVYYCMQGTHWPPTFGQGTKVEIK

SEQ ID NO: 462 - protein, 112 aa, Artificial Sequence
  Synthetic peptide
DVVMTQTPLSLPVTLGQPASISCRSSQSLVYRDANTYLSWFQQRPGQSPRRLIYKVSNWQSGVPDRFSGSGSGTDFTLKISRVEAEDVGVYYCMQGTHWPPTFGQGTKVEIK

SEQ ID NO: 463 - protein, 112 aa, Artificial Sequence
  Synthetic peptide
DVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGCGTKVEIK

SEQ ID NO: 464 - protein, 112 aa, Artificial Sequence
  Synthetic peptide
DVVMTQTPLSLPVTLGQPASISCRSSQSLVYREGNTYLSWFQQRPGQSPRRLIYKVSNWQSGVPDRFSGGGSGTDFTLKISRVEAEDVGVYYCMQGTHWPPTFGCGTKVEIK

SEQ ID NO: 465 - protein, 112 aa, Artificial Sequence
  Synthetic peptide
DVVMTQTPLSLPVTLGQPASISCRSSQSLVYRDANTYLSWFQQRPGQSPRRLIYKVSNWQSGVPDRFSGGGSGTDFTLKISRVEAEDVGVYYCMQGTHWPPTFGCGTKVEIK

SEQ ID NO: 466 - protein, 112 aa, Artificial Sequence
  Synthetic peptide
DVVMTQTPLSLPVTLGQPASISCRSSQSLVYRDGQTYLSWFQQRPGQSPRRLIYKVSNWQSGVPDRFSGGGSGTDFTLKISRVEAEDVGVYYCMQGTHWPPTFGCGTKVEIK

SEQ ID NO: 467 - protein, 112 aa, Artificial Sequence
  Synthetic peptide
DVVMTQTPLSLPVTLGQPASISCRSSQSLVYRDGNAYLSWFQQRPGQSPRRLIYKVSNWQSGVPDRFSGGGSGTDFTLKISRVEAEDVGVYYCMQGTHWPPTFGCGTKVEIK

SEQ ID NO: 468 - protein, 112 aa, Artificial Sequence
  Synthetic peptide
DVVMTQTPLSLPVTLGQPASISCRSSQSLVYRDGNTYLSWFQQRPGQSPRRLIYKVSNWQSGVPDRFSGSGSGTDFTLKISRVEAEDVGVYYCMQGTHWPPTFGCGTKVEIK

SEQ ID NO: 469 - protein, 112 aa, Artificial Sequence
  Synthetic peptide
DVVMTQTPLSLPVTLGQPASISCRSSQSLVYREGNTYLSWFQQRPGQSPRRLIYKVSNWQSGVPDRFSGSGSGTDFTLKISRVEAEDVGVYYCMQGTHWPPTFGCGTKVEIK

SEQ ID NO: 470 - protein, 112 aa, Artificial Sequence
  Synthetic peptide
DVVMTQTPLSLPVTLGQPASISCRSSQSLVYRDANTYLSWFQQRPGQSPRRLIYKVSNWQSGVPDRFSGSGSGTDFTLKISRVEAEDVGVYYCMQGTHWPPTFGCGTKVEIK

SEQ ID NO: 471 - protein, 250 aa, Artificial Sequence
  Synthetic peptide
QVQLVQSGAEVKKPGASVKVSCKASGYTFTNYYMHWVRQAPGLGLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYREGNTYLSWFQQRPGQSPRRLIYKVSNWQSGVPDRFSGGGSGTDFTLKISRVEAEDVGVYYCMQGTHWPPTFGQGTKVEIK

SEQ ID NO: 472 - protein, 250 aa, Artificial Sequence
  Synthetic peptide
QVQLVQSGAEVKKPGASVKVSCKASGYTFTNYYMHWVRQAPGLGLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDANTYLSWFQQRPGQSPRRLIYKVSNWQSGVPDRFSGGGSGTDFTLKISRVEAEDVGVYYCMQGTHWPPTFGQGTKVEIK

SEQ ID NO: 473 - protein, 250 aa, Artificial Sequence
  Synthetic peptide
QVQLVQSGAEVKKPGASVKVSCKASGYTFTNYYMHWVRQAPGLGLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGQTYLSWFQQRPGQSPRRLIYKVSNWQSGVPDRFSGGGSGTDFTLKISRVEAEDVGVYYCMQGTHWPPTFGQGTKVEIK

SEQ ID NO: 474 - protein, 250 aa, Artificial Sequence
  Synthetic peptide
QVQLVQSGAEVKKPGASVKVSCKASGYTFTNYYMHWVRQAPGLGLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNAYLSWFQQRPGQSPRRLIYKVSNWQSGVPDRFSGGGSGTDFTLKISRVEAEDVGVYYCMQGTHWPPTFGQGTKVEIK

SEQ ID NO: 475 - protein, 250 aa, Artificial Sequence
  Synthetic peptide
QVQLVQSGAEVKKPGASVKVSCKASGYTFTNYYMHWVRQAPGLGLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGSGSGTDFTLKISRVEAEDVGVYYCMQGTHWPPTFGQGTKVEIK

SEQ ID NO: 476 - protein, 250 aa, Artificial Sequence
  Synthetic peptide
QVQLVQSGAEVKKPGASVKVSCKASGYTFTNYYMHWVRQAPGQGLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGQGTKVEIK

SEQ ID NO: 477 - protein, 250 aa, Artificial Sequence
  Synthetic peptide
QVQLVQSGAEVKKPGASVKVSCKASGYTFTNYYMHWVRQAPGLGLEWMGIINPSEGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGQGTKVEIK

SEQ ID NO: 478 - protein, 250 aa, Artificial Sequence
  Synthetic peptide
QVQLVQSGAEVKKPGASVKVSCKASGYTFTNYYMHWVRQAPGLGLEWMGIINPSDASTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGQGTKVEIK

SEQ ID NO: 479 - protein, 250 aa, Artificial Sequence
  Synthetic peptide
QVQLVQSGAEVKKPGASVKVSCKASGYTFTNYYMHWVRQAPGQGLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGSGSGTDFTLKISRVEAEDVGVYYCMQGTHWPPTFGQGTKVEIK

SEQ ID NO: 480 - protein, 250 aa, Artificial Sequence
  Synthetic peptide
QVQLVQSGAEVKKPGASVKVSCKASGYTFTNYYMHWVRQAPGQGLEWMGIINPSEGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYREGNTYLSWFQQRPGQSPRRLIYKVSNWQSGVPDRFSGSGSGTDFTLKISRVEAEDVGVYYCMQGTHWPPTFGQGTKVEIK

SEQ ID NO: 481 - protein, 250 aa, Artificial Sequence
  Synthetic peptide
QVQLVQSGAEVKKPGASVKVSCKASGYTFTNYYMHWVRQAPGQGLEWMGIINPSDASTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDANTYLSWFQQRPGQSPRRLIYKVSNWQSGVPDRFSGSGSGTDFTLKISRVEAEDVGVYYCMQGTHWPPTFGQGTKVEIK

SEQ ID NO: 482 - protein, 250 aa, Artificial Sequence
  Synthetic peptide
QVQLVQSGAEVKKPGASVKVSCKASGYTFTNYYMHWVRQAPGLCLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGCGTKVEIK

SEQ ID NO: 483 - protein, 250 aa, Artificial Sequence
  Synthetic peptide
QVQLVQSGAEVKKPGASVKVSCKASGYTFTNYYMHWVRQAPGLCLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYREGNTYLSWFQQRPGQSPRRLIYKVSNWQSGVPDRFSGGGSGTDFTLKISRVEAEDVGVYYCMQGTHWPPTFGCGTKVEIK

SEQ ID NO: 484 - protein, 250 aa, Artificial Sequence
  Synthetic peptide
QVQLVQSGAEVKKPGASVKVSCKASGYTFTNYYMHWVRQAPGLCLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDANTYLSWFQQRPGQSPRRLIYKVSNWQSGVPDRFSGGGSGTDFTLKISRVEAEDVGVYYCMQGTHWPPTFGCGTKVEIK

SEQ ID NO: 485 - protein, 250 aa, Artificial Sequence
  Synthetic peptide
QVQLVQSGAEVKKPGASVKVSCKASGYTFTNYYMHWVRQAPGLCLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGQTYLSWFQQRPGQSPRRLIYKVSNWQSGVPDRFSGGGSGTDFTLKISRVEAEDVGVYYCMQGTHWPPTFGCGTKVEIK

SEQ ID NO: 486 - protein, 250 aa, Artificial Sequence
  Synthetic peptide
QVQLVQSGAEVKKPGASVKVSCKASGYTFTNYYMHWVRQAPGLCLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNAYLSWFQQRPGQSPRRLIYKVSNWQSGVPDRFSGGGSGTDFTLKISRVEAEDVGVYYCMQGTHWPPTFGCGTKVEIK

SEQ ID NO: 487 - protein, 250 aa, Artificial Sequence
  Synthetic peptide
QVQLVQSGAEVKKPGASVKVSCKASGYTFTNYYMHWVRQAPGLCLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGSGSGTDFTLKISRVEAEDVGVYYCMQGTHWPPTFGCGTKVEIK

SEQ ID NO: 488 - protein, 250 aa, Artificial Sequence
  Synthetic peptide
QVQLVQSGAEVKKPGASVKVSCKASGYTFTNYYMHWVRQAPGQCLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGCGTKVEIK

SEQ ID NO: 489 - protein, 250 aa, Artificial Sequence
  Synthetic peptide
QVQLVQSGAEVKKPGASVKVSCKASGYTFTNYYMHWVRQAPGLCLEWMGIINPSEGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGCGTKVEIK

SEQ ID NO: 490 - protein, 250 aa, Artificial Sequence
  Synthetic peptide
QVQLVQSGAEVKKPGASVKVSCKASGYTFTNYYMHWVRQAPGLCLEWMGIINPSDASTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGCGTKVEIK

SEQ ID NO: 491 - protein, 250 aa, Artificial Sequence
  Synthetic peptide
QVQLVQSGAEVKKPGASVKVSCKASGYTFTNYYMHWVRQAPGQCLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGSGSGTDFTLKISRVEAEDVGVYYCMQGTHWPPTFGCGTKVEIK

SEQ ID NO: 492 - protein, 250 aa, Artificial Sequence
  Synthetic peptide
QVQLVQSGAEVKKPGASVKVSCKASGYTFTNYYMHWVRQAPGQCLEWMGIINPSEGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYREGNTYLSWFQQRPGQSPRRLIYKVSNWQSGVPDRFSGSGSGTDFTLKISRVEAEDVGVYYCMQGTHWPPTFGCGTKVEIK

SEQ ID NO: 493 - protein, 250 aa, Artificial Sequence
  Synthetic peptide
QVQLVQSGAEVKKPGASVKVSCKASGYTFTNYYMHWVRQAPGQCLEWMGIINPSDASTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDANTYLSWFQQRPGQSPRRLIYKVSNWQSGVPDRFSGSGSGTDFTLKISRVEAEDVGVYYCMQGTHWPPTFGCGTKVEIK

SEQ ID NO: 494 - protein, 505 aa, Artificial Sequence
  Synthetic peptide
QVQLVQSGAEVKKPGASVKVSCKASGYTFTNYYMHWVRQAPGLGLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYREGNTYLSWFQQRPGQSPRRLIYKVSNWQSGVPDRFSGGGSGTDFTLKISRVEAEDVGVYYCMQGTHWPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 495 - protein, 505 aa, Artificial Sequence
  Synthetic peptide
QVQLVQSGAEVKKPGASVKVSCKASGYTFTNYYMHWVRQAPGLGLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDANTYLSWFQQRPGQSPRRLIYKVSNWQSGVPDRFSGGGSGTDFTLKISRVEAEDVGVYYCMQGTHWPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 496 - protein, 505 aa, Artificial Sequence
  Synthetic peptide
QVQLVQSGAEVKKPGASVKVSCKASGYTFTNYYMHWVRQAPGLGLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGQTYLSWFQQRPGQSPRRLIYKVSNWQSGVPDRFSGGGSGTDFTLKISRVEAEDVGVYYCMQGTHWPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 497 - protein, 505 aa, Artificial Sequence
  Synthetic peptide
QVQLVQSGAEVKKPGASVKVSCKASGYTFTNYYMHWVRQAPGLGLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNAYLSWFQQRPGQSPRRLIYKVSNWQSGVPDRFSGGGSGTDFTLKISRVEAEDVGVYYCMQGTHWPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 498 - protein, 505 aa, Artificial Sequence
  Synthetic peptide
QVQLVQSGAEVKKPGASVKVSCKASGYTFTNYYMHWVRQAPGLGLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGSGSGTDFTLKISRVEAEDVGVYYCMQGTHWPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 499 - protein, 505 aa, Artificial Sequence
  Synthetic peptide
QVQLVQSGAEVKKPGASVKVSCKASGYTFTNYYMHWVRQAPGQGLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 500 - protein, 505 aa, Artificial Sequence
  Synthetic peptide
QVQLVQSGAEVKKPGASVKVSCKASGYTFTNYYMHWVRQAPGLGLEWMGIINPSEGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 501 - protein, 505 aa, Artificial Sequence
  Synthetic peptide
QVQLVQSGAEVKKPGASVKVSCKASGYTFTNYYMHWVRQAPGLGLEWMGIINPSDASTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 502 - protein, 505 aa, Artificial Sequence
  Synthetic peptide
QVQLVQSGAEVKKPGASVKVSCKASGYTFTNYYMHWVRQAPGQGLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGSGSGTDFTLKISRVEAEDVGVYYCMQGTHWPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 503 - protein, 505 aa, Artificial Sequence
  Synthetic peptide
QVQLVQSGAEVKKPGASVKVSCKASGYTFTNYYMHWVRQAPGQGLEWMGIINPSEGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYREGNTYLSWFQQRPGQSPRRLIYKVSNWQSGVPDRFSGSGSGTDFTLKISRVEAEDVGVYYCMQGTHWPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 504 - protein, 505 aa, Artificial Sequence
  Synthetic peptide
QVQLVQSGAEVKKPGASVKVSCKASGYTFTNYYMHWVRQAPGQGLEWMGIINPSDASTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDANTYLSWFQQRPGQSPRRLIYKVSNWQSGVPDRFSGSGSGTDFTLKISRVEAEDVGVYYCMQGTHWPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 505 - protein, 505 aa, Artificial Sequence
  Synthetic peptide
QVQLVQSGAEVKKPGASVKVSCKASGYTFTNYYMHWVRQAPGLCLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 506 - protein, 505 aa, Artificial Sequence
  Synthetic peptide
QVQLVQSGAEVKKPGASVKVSCKASGYTFTNYYMHWVRQAPGLCLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYREGNTYLSWFQQRPGQSPRRLIYKVSNWQSGVPDRFSGGGSGTDFTLKISRVEAEDVGVYYCMQGTHWPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 507 - protein, 505 aa, Artificial Sequence
  Synthetic peptide
QVQLVQSGAEVKKPGASVKVSCKASGYTFTNYYMHWVRQAPGLCLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDANTYLSWFQQRPGQSPRRLIYKVSNWQSGVPDRFSGGGSGTDFTLKISRVEAEDVGVYYCMQGTHWPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 508 - protein, 505 aa, Artificial Sequence
  Synthetic peptide
QVQLVQSGAEVKKPGASVKVSCKASGYTFTNYYMHWVRQAPGLCLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGQTYLSWFQQRPGQSPRRLIYKVSNWQSGVPDRFSGGGSGTDFTLKISRVEAEDVGVYYCMQGTHWPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 509 - protein, 505 aa, Artificial Sequence
  Synthetic peptide
QVQLVQSGAEVKKPGASVKVSCKASGYTFTNYYMHWVRQAPGLCLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNAYLSWFQQRPGQSPRRLIYKVSNWQSGVPDRFSGGGSGTDFTLKISRVEAEDVGVYYCMQGTHWPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 510 - protein, 505 aa, Artificial Sequence
  Synthetic peptide
QVQLVQSGAEVKKPGASVKVSCKASGYTFTNYYMHWVRQAPGLCLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGSGSGTDFTLKISRVEAEDVGVYYCMQGTHWPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 511 - protein, 505 aa, Artificial Sequence
  Synthetic peptide
QVQLVQSGAEVKKPGASVKVSCKASGYTFTNYYMHWVRQAPGQCLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 512 - protein, 505 aa, Artificial Sequence
  Synthetic peptide
QVQLVQSGAEVKKPGASVKVSCKASGYTFTNYYMHWVRQAPGLCLEWMGIINPSEGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 513 - protein, 505 aa, Artificial Sequence
  Synthetic peptide
QVQLVQSGAEVKKPGASVKVSCKASGYTFTNYYMHWVRQAPGLCLEWMGIINPSDASTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 514 - protein, 505 aa, Artificial Sequence
  Synthetic peptide
QVQLVQSGAEVKKPGASVKVSCKASGYTFTNYYMHWVRQAPGQCLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGSGSGTDFTLKISRVEAEDVGVYYCMQGTHWPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 515 - protein, 505 aa, Artificial Sequence
  Synthetic peptide
QVQLVQSGAEVKKPGASVKVSCKASGYTFTNYYMHWVRQAPGQCLEWMGIINPSEGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYREGNTYLSWFQQRPGQSPRRLIYKVSNWQSGVPDRFSGSGSGTDFTLKISRVEAEDVGVYYCMQGTHWPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 516 - protein, 505 aa, Artificial Sequence
  Synthetic peptide
QVQLVQSGAEVKKPGASVKVSCKASGYTFTNYYMHWVRQAPGQCLEWMGIINPSDASTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDANTYLSWFQQRPGQSPRRLIYKVSNWQSGVPDRFSGSGSGTDFTLKISRVEAEDVGVYYCMQGTHWPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 517 - protein, 984 aa, Artificial Sequence
  Synthetic peptide
QVQLQESGPGLVKPSETLSLTCTVSGGSISSYYWSWIRQPPGKGLEWIGYVYYSGTTNYNPSLKSRVTISVDTSKNQFSLKLSSVTAADTAVYYCASIAVTGFYFDYWGQGTLVTVSSGGGGSGGGGSGGGGSEIVLTQSPGTLSLSPGERVTLSCRASQRVNNNYLAWYQQRPGQAPRLLIYGASSRATGIPDRFSGSGSGTDFTLTISRLEPEDFAVYYCQQYDRSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 518 - protein, 982 aa, Artificial Sequence
  Synthetic peptide
QVQLQESGPGLVKPSETLSLTCTVSGGSISSYYWSWIRQPPGKGLEWIGYVYYSGTTNYNPSLKSRVTISVDTSKNQFSLKLSSVTAADTAVYYCASIAVTGFYFDYWGQGTLVTVSSGGGGSGGGGSGGGGSEIVLTQSPGTLSLSPGERVTLSCRASQRVNNNYLAWYQQRPGQAPRLLIYGASSRATGIPDRFSGSGSGTDFTLTISRLEPEDFAVYYCQQYDRSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 519 - protein, 984 aa, Artificial Sequence
  Synthetic peptide
QVQLQESGPGLVKPSETLSLTCTVSGGSISSYYWSWIRQPPGKCLEWIGYVYYSGTTNYNPSLKSRVTISVDTSKNQFSLKLSSVTAADTAVYYCASIAVTGFYFDYWGQGTLVTVSSGGGGSGGGGSGGGGSEIVLTQSPGTLSLSPGERVTLSCRASQRVNNNYLAWYQQRPGQAPRLLIYGASSRATGIPDRFSGSGSGTDFTLTISRLEPEDFAVYYCQQYDRSPLTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 520 - protein, 982 aa, Artificial Sequence
  Synthetic peptide
QVQLQESGPGLVKPSETLSLTCTVSGGSISSYYWSWIRQPPGKCLEWIGYVYYSGTTNYNPSLKSRVTISVDTSKNQFSLKLSSVTAADTAVYYCASIAVTGFYFDYWGQGTLVTVSSGGGGSGGGGSGGGGSEIVLTQSPGTLSLSPGERVTLSCRASQRVNNNYLAWYQQRPGQAPRLLIYGASSRATGIPDRFSGSGSGTDFTLTISRLEPEDFAVYYCQQYDRSPLTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 521 - protein, 984 aa, Artificial Sequence
  Synthetic peptide
QVQLQESGPGLVKPSETLSLTCTVSGASISSFYWSWIRQPPGKGLEWIGYIYYSGTTNYNPSLKSRVTISVDTSKNQFSLKLSSVTAADTAVYYCARIAVAGFFFDYWGQGTLVTVSSGGGGSGGGGSGGGGSEIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 522 - protein, 982 aa, Artificial Sequence
  Synthetic peptide
QVQLQESGPGLVKPSETLSLTCTVSGASISSFYWSWIRQPPGKGLEWIGYIYYSGTTNYNPSLKSRVTISVDTSKNQFSLKLSSVTAADTAVYYCARIAVAGFFFDYWGQGTLVTVSSGGGGSGGGGSGGGGSEIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 523 - protein, 984 aa, Artificial Sequence
  Synthetic peptide
QVQLQESGPGLVKPSETLSLTCTVSGASISSFYWSWIRQPPGKCLEWIGYIYYSGTTNYNPSLKSRVTISVDTSKNQFSLKLSSVTAADTAVYYCARIAVAGFFFDYWGQGTLVTVSSGGGGSGGGGSGGGGSEIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 524 - protein, 982 aa, Artificial Sequence
  Synthetic peptide
QVQLQESGPGLVKPSETLSLTCTVSGASISSFYWSWIRQPPGKCLEWIGYIYYSGTTNYNPSLKSRVTISVDTSKNQFSLKLSSVTAADTAVYYCARIAVAGFFFDYWGQGTLVTVSSGGGGSGGGGSGGGGSEIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 525 - protein, 993 aa, Artificial Sequence
  Synthetic peptide
QVQLVQSGAEVKKPGASVKVSCKASGYTFTNYYMHWVRQAPGLGLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 526 - protein, 991 aa, Artificial Sequence
  Synthetic peptide
QVQLVQSGAEVKKPGASVKVSCKASGYTFTNYYMHWVRQAPGLGLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 527 - protein, 993 aa, Artificial Sequence
  Synthetic peptide
QVQLVQSGAEVKKPGASVKVSCKASGYTFTNYYMHWVRQAPGLCLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 528 - protein, 991 aa, Artificial Sequence
  Synthetic peptide
QVQLVQSGAEVKKPGASVKVSCKASGYTFTNYYMHWVRQAPGLCLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 529 - protein, 118 aa, Artificial Sequence
  Synthetic peptide
QVQLQESGPGLVKPSETLSLTCTVSGASISSFYWSWIRQPPGKCLEWIGYIYYSGTTNYNPSLKSRVTISVDTSKNQFSLKLSSVTAADTAVYYCARIAVAGFFFDYWGQGTLVTVSS

SEQ ID NO: 530 - protein, 108 aa, Artificial Sequence
  Synthetic peptide
EIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGCGTKVEIK

SEQ ID NO: 531 - protein, 241 aa, Artificial Sequence
  Synthetic peptide
QVQLQESGPGLVKPSETLSLTCTVSGASISSFYWSWIRQPPGKCLEWIGYIYYSGTTNYNPSLKSRVTISVDTSKNQFSLKLSSVTAADTAVYYCARIAVAGFFFDYWGQGTLVTVSSGGGGSGGGGSGGGGSEIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGCGTKVEIK

SEQ ID NO: 532 - protein, 496 aa, Artificial Sequence
  Synthetic peptide
QVQLQESGPGLVKPSETLSLTCTVSGASISSFYWSWIRQPPGKCLEWIGYIYYSGTTNYNPSLKSRVTISVDTSKNQFSLKLSSVTAADTAVYYCARIAVAGFFFDYWGQGTLVTVSSGGGGSGGGGSGGGGSEIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 533 - protein, 227 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 534 - protein, 225 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 535 - protein, 227 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 536 - protein, 225 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 537 - protein, 227 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 538 - protein, 225 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 539 - protein, 227 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPCEEQYNSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 540 - protein, 225 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPCEEQYNSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 541 - protein, 484 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 542 - protein, 480 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 543 - protein, 484 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 544 - protein, 480 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 545 - protein, 484 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 546 - protein, 480 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 547 - protein, 484 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPCEEQYNSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYNSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 548 - protein, 480 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPCEEQYNSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYNSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 549 - protein, 20 aa, Artificial Sequence
  Synthetic peptide
GGGGSGGGGSGGGGSGGGGS

SEQ ID NO: 550 - protein, 25 aa, Artificial Sequence
  Synthetic peptide
GGGGSGGGGSGGGGSGGGGSGGGGS

SEQ ID NO: 551 - protein, 30 aa, Artificial Sequence
  Synthetic peptide
GGGGSGGGGSGGGGSGGGGSGGGGSGGGGS

SEQ ID NO: 552 - protein, 35 aa, Artificial Sequence
  Synthetic peptide
GGGGSGGGGSGGGGSGGGGSGGGGSGGGGSGGGGS

SEQ ID NO: 553 - protein, 40 aa, Artificial Sequence
  Synthetic peptide
GGGGSGGGGSGGGGSGGGGSGGGGSGGGGSGGGGSGGGGS

SEQ ID NO: 554 - protein, 503 aa, Artificial Sequence
  Synthetic peptide
QVQLQESGPGLVKPSETLSLTCTVSGDSISSYYWTWIRQPPGKGLEWIGYIYYSGTTNYNPSLKSRVTISVDTSKSQFSLKLSSVTAADTAVYYCASIAVRGFFFDYWGQGTLVTVSSGGGGSGGGGSGGGGSEIVLTQSPGTLSLSPGERATLSCRASQSVSSSYLAWYQQKPGQAPRLLIYGASTRATGIPDRFSGSGSGTDFTLTISRLEPEDFAVYYCQQYGTSPLTFGGGTKVEIKRSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

The invention claimed is:

1. A bispecific antibody construct comprising a first binding domain which binds to human delta-like 3 (DLL3) on the surface of a target cell and a second binding domain which binds to human and macaque CD3 on the surface of a T cell, wherein the first binding domain binds to an epitope of DLL3 within the amino acid sequence of SEQ ID NO: 258.

2. The antibody construct according to claim 1, wherein the first binding domain further binds to macaque DLL3.

3. The antibody construct according to claim 2, wherein the macaque DLL3 is *Macaca fascicularis* DLL3.

4. The antibody construct according to claim 1, wherein the second binding domain binds to human CD3 epsilon and to *Callithrix jacchus, Saguinus Oedipus* or *Saimiri sciureus* CD3 epsilon.

5. The antibody construct according to claim 1, wherein the antibody construct is in a format selected from the group consisting of: (scFv)$_2$, diabodies and oligomers of the foregoing formats.

6. The antibody construct according to claim 1, wherein the first binding domain comprises a VH region comprising CDR-H1, CDR-H2 and CDR-H3 and a VL region comprising CDR-L1, CDR-L2 and CDR-L3 selected from the group consisting of:

a) CDR-H1 comprising the amino acid sequence of SEQ ID NO: 31, CDR-H2 comprising the amino acid sequence of SEQ ID NO: 32, CDR-H3 comprising the amino acid sequence of SEQ ID NO: 33, CDR-L1 comprising the amino acid sequence of SEQ ID NO: 34, CDR-L2 comprising the amino acid sequence of SEQ ID NO: 35, and CDR-L3 comprising the amino acid sequence of SEQ ID NO: 36;

b) CDR-H1 comprising the amino acid sequence of SEQ ID NO: 41, CDR-H2 comprising the amino acid sequence of SEQ ID NO: 42, CDR-H3 comprising the amino acid sequence of SEQ ID NO: 43, CDR-L1 comprising the amino acid sequence of SEQ ID NO: 44, CDR-L2 comprising the amino acid sequence of SEQ ID NO: 45u, and CDR-L3 comprising the amino acid sequence of SEQ ID NO: 46;
c) CDR-H1 comprising the amino acid sequence of SEQ ID NO: 51, CDR-H2 comprising the amino acid sequence of SEQ ID NO: 52, CDR-H3 comprising the amino acid sequence of SEQ ID NO: 53, CDR-L1 comprising the amino acid sequence of SEQ ID NO: 54, CDR-L2 comprising the amino acid sequence of SEQ ID NO: 55, and CDR-L3 comprising the amino acid sequence of SEQ ID NO: 56;
d) CDR-H1 comprising the amino acid sequence of SEQ ID NO: 61), CDR-H2 comprising the amino acid sequence of SEQ ID NO: 62, CDR-H3 comprising the amino acid sequence of SEQ ID NO: 63, CDR-L1 comprising the amino acid sequence of SEQ ID NO: 64, CDR-L2 comprising the amino acid sequence of SEQ ID NO: 65, and CDR-L3 comprising the amino acid sequence of SEQ ID NO: 66;
e) CDR-H1 comprising the amino acid sequence of SEQ ID NO: 71, CDR-H2 comprising the amino acid sequence of SEQ ID NO: 72, CDR-H3 comprising the amino acid sequence of SEQ ID NO: 73, CDR-L1 comprising the amino acid sequence of SEQ ID NO: 74, CDR-L2 comprising the amino acid sequence of SEQ ID NO: 75, and CDR-L3 comprising the amino acid sequence of SEQ ID NO: 76;
f) CDR-H1 comprising the amino acid sequence of SEQ ID NO: 81, CDR-H2 comprising the amino acid sequence of SEQ ID NO: 82, CDR-H3 comprising the amino acid sequence of SEQ ID NO: 83, CDR-L1 comprising the amino acid sequence of SEQ ID NO: 84, CDR-L2 comprising the amino acid sequence of SEQ ID NO: 85, and CDR-L3 comprising the amino acid sequence of SEQ ID NO: 86;
g) CDR-H1 comprising the amino acid sequence of SEQ ID NO: 91, CDR-H2 comprising the amino acid sequence of SEQ ID NO: 92, CDR-H3 comprising the amino acid sequence of SEQ ID NO: 93, CDR-L1 comprising the amino acid sequence of SEQ ID NO: 94, CDR-L2 comprising the amino acid sequence of SEQ ID NO: 95, and CDR-L3 comprising the amino acid sequence of SEQ ID NO: 96;
h) CDR-H1 comprising the amino acid sequence of SEQ ID NO: 101, CDR-H2 comprising the amino acid sequence of SEQ ID NO: 102, CDR-H3 comprising the amino acid sequence of SEQ ID NO: 103, CDR-L1 comprising the amino acid sequence of SEQ ID NO: 104, CDR-L2 comprising the amino acid sequence of SEQ ID NO: 105, and CDR-L3 comprising the amino acid sequence of SEQ ID NO: 106; and
i) CDR-H1 comprising the amino acid sequence of SEQ ID NO: 111, CDR-H2 comprising the amino acid sequence of SEQ ID NO: 112, CDR-H3 comprising the amino acid sequence of SEQ ID NO: 113, CDR-L1 comprising the amino acid sequence of SEQ ID NO: 114, CDR-L2 comprising the amino acid sequence of SEQ ID NO: 115, and CDR-L3 comprising the amino acid sequence of SEQ ID NO: 116.

7. The antibody construct according to claim 1, wherein the first binding domain comprises a VH region comprising the amino acid sequence selected from the group consisting of: SEQ ID NO: 37, SEQ ID NO: 47, SEQ ID NO: 57, SEQ ID NO: 67, SEQ ID NO: 77, SEQ ID NO: 87, SEQ ID NO: 97, SEQ ID NO: 107, SEQ ID NO: 117, SEQ ID NO: 435, and SEQ ID NO: 529.

8. The antibody construct according to claim 1, wherein the first binding domain comprises a VL region comprising the amino acid sequence selected from the group consisting of: SEQ ID NO: 38, SEQ ID NO: 48, SEQ ID NO: 58, SEQ ID NO: 68, SEQ ID NO: 78, SEQ ID NO: 88, SEQ ID NO: 98, SEQ ID NO: 108, SEQ ID NO: 118, SEQ ID NO: 436, and SEQ ID NO: 530.

9. The antibody construct according to claim 1, wherein the first binding domain comprises a VH region and a VL region comprising the pair of amino acid sequences, respectively, selected from the group consisting of: SEQ ID NOs: 37+38; SEQ ID NOs: 47+48; SEQ ID NOs: 57+58; SEQ ID NOs: 67+68; SEQ ID NOs: 77+78; SEQ ID NOs: 87+88; SEQ ID NOs: 97+98; SEQ ID NOs: 107+108; SEQ ID NOs: 117+118; SEQ ID NOs: 435+436; and SEQ ID NOs: 529+530.

10. The antibody construct according to claim 1, wherein the first binding domain comprises a polypeptide comprising the amino acid sequence selected from the group consisting of: SEQ ID NO: 39, SEQ ID NO: 49, SEQ ID NO: 59, SEQ ID NO: 69, SEQ ID NO: 79, SEQ ID NO: 89, SEQ ID NO: 99, SEQ ID NO: 109, SEQ ID NO: 119, SEQ ID NO: 437, and SEQ ID NO: 531.

11. The antibody construct according to claim 1, comprising a polypeptide comprising the amino acid sequence selected from the group consisting of: SEQ ID NO: 40, SEQ ID NO: 50, SEQ ID NO: 60, SEQ ID NO: 70, SEQ ID NO: 80, SEQ ID NO: 90, SEQ ID NO: 100, SEQ ID NO: 110, SEQ ID NO: 120, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 438, and SEQ ID NO: 532.

12. The antibody construct according to claim 1, comprising a polypeptide comprising the amino acid sequence selected from the group consisting of: SEQ ID NO: 517, SEQ ID NO: 518, SEQ ID NO: 519, SEQ ID NO: 520, SEQ ID NO: 521, SEQ ID NO: 522, SEQ ID NO: 523, and SEQ ID NO: 524.

13. A pharmaceutical composition comprising the antibody construct according to claim 1 and a carrier, stabilizer, excipient, diluent, solubilizer, surfactant, emulsifier, preservative, or adjuvant.

14. A kit comprising the antibody construct according to claim 1 and a recipient and, optionally, directions for use.

15. A method for treating a tumor, cancer disease or metastatic cancer disease expressing DLL3, comprising the step of administering to a subject in need thereof an effective amount of the antibody construct according to claim 1.

16. The method according to claim 15, wherein the tumor or cancer disease is small cell lung cancer (SCLC) or melanoma.

* * * * *

UNITED STATES PATENT AND TRADEMARK OFFICE
CERTIFICATE OF CORRECTION

PATENT NO. : 10,294,300 B2
APPLICATION NO. : 15/225107
DATED : May 21, 2019
INVENTOR(S) : Tobias Raum et al.

Page 1 of 1

It is certified that error appears in the above-identified patent and that said Letters Patent is hereby corrected as shown below:

In the Specification

Column 37, Line 36, "≤520 nM, more preferably ≤510 nM," should be -- ≤20 nM, more preferably ≤10 nM, --.

Column 37, Line 37, "≤55 nM, even more preferably ≤52 nM," should be -- ≤5 nM, even more preferably ≤2 nM, --.

Column 37, Line 38, "≤51 nM, even more preferably ≤50.6" should be -- ≤1 nM, even more preferably ≤0.6 --.

Column 37, Lines 39-40, "≤50.5 nM, and most preferably ≤50.4 nM." should be -- ≤0.5 nM, and most preferably ≤0.4 nM. --.

Signed and Sealed this
Twenty-sixth Day of November, 2019

Andrei Iancu
*Director of the United States Patent and Trademark Office*